United States Patent 11,141,474 (ARTIFICIAL NUCLEIC ACID MOLECULES ENCODING A NOROVIRUS ANTIGEN AND USES THEREOF) - sequence listing, part 8

SEQ ID NO: 16955 - RNA, 1617 nt, Artificial Sequence
  derived and/or modified sequence opt2 from VP1__Norovirus_and/or_Norovirus-like__KX514351
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccggccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucaaccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccguccaggagaugaccaacucccgcuuccccgccacccucgacaagcucuucaccggccccuccuccaaccucgucguccagccccagaacggccgcugcaugaucgacggcguccuccucggcaccacccagcucucccccgucaacaucugcaccuuccgcggcgacgucacccaccuccgcgacuccaccaucuacaccaugaaccucgccucccccaacuggaacaacuacgaccccaccgaggagauccccgccccccucggcacccccgacuucgucggcaagauccagggcguccucacccagaccaccaagggcgagggcuccacccgcggccaccgcgccaccgucuacgucggcuccgccaacuacacccccaagcucggcaagguccaguucgagaccaacaccaccaacgaccucuacgcccaccagaacaccaaguucacccccgucggcgucguccagggcggcgaguccgcccaccgcuccgagccccagcaguggguccuccccggcuucuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16956 - RNA, 1617 nt, Artificial Sequence
  derived and/or modified sequence opt2 from VP1__Norovirus_and/or_Norovirus-like__KC517372
augaagauggccuccaacgacgccaaccccuccgacggcuccgccgucaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacgcccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucgcccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccuccucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccuccggcuacuuccgcuucgacuccugggucaaccaguucuacacccucgcccccaugggcaacggcaccggccgccgccgcuga

SEQ ID NO: 16957 - RNA, 1617 nt, Artificial Sequence
  derived and/or modified sequence opt2 from VP1__Norovirus_and/or_Norovirus-like__JN400613
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuuccgcggccgcuccuccgcccucgucguccacccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcggcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgaguacaagcuccacaaguccgacuacgucaccgucgcccacaccggccagcacgaccucgucaucccccccaacggcuacuuccgcuucgacuccugggucaaccaguucuacacccucgccgccaugggcaacggcaccggccgccgccgcuga

SEQ ID NO: 16958 - RNA, 1617 nt, Artificial Sequence
  derived and/or modified sequence opt2 from VP1__Norovirus_and/or_Norovirus-like__KX514291
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucaccggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucauccagggcggcgaguccgcccaccgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16959 - RNA, 1617 nt, Artificial Sequence
  derived and/or modified sequence opt2 from VP1__Norovirus_and/or_Norovirus-like__KX514219
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgaguccccccagcgcuccgagccccagcaguggguccuccccuccuacuccggccgcgacacccccaacguccaccucgcccccgccgucgcccccaccuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 16960 - RNA, 1617 nt, Artificial Sequence
  derived and/or modified sequence opt2 from VP1__Norovirus_and/or_Norovirus-like__AB933668
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgucgucaagaccacccucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16961 - RNA, 1617 nt, Artificial Sequence
  derived and/or modified sequence opt2 from VP1__Norovirus_and/or_Norovirus-like__KJ678149
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgaccucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccauccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16962 - RNA, 1617 nt, Artificial Sequence
  derived and/or modified sequence opt2 from VP1__Norovirus_and/or_Norovirus-like__KP244318
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacauccgcaccuuccgcggcgacgucacccacauccccggcucccgcaacuacaccaugaacuccgccucccagaacuggaacuccuacgaccccaccgaggagauccccgccccccucggcacccccgacuucgucggcaagauccagggcguccucacccagaccacccgcgccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16963 - RNA, 1617 nt, Artificial Sequence
  derived and/or modified sequence opt2 from VP1__Norovirus_and/or_Norovirus-like__KX514362
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaccccggcggcuccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16964 - RNA, 1617 nt, Artificial Sequence
  derived and/or modified sequence opt2 from VP1__Norovirus_and/or_Norovirus-like__KX514329
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacuccggcaacuccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16965 - RNA, 1617 nt, Artificial Sequence
  derived and/or modified sequence opt2 from VP1__Norovirus_and/or_Norovirus-like__KJ678152
augaagauggccuccuccgacgccaaccccugcgacggcuccgccgccaaccucguccccgaggucaacaacgaggucauggcccucgagcccgucgucggcgccgccaucgccgcccccgucggcggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccacccuccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16966 - RNA, 1617 nt, Artificial Sequence
  derived and/or modified sequence opt2 from VP1__Norovirus_and/or_Norovirus-like__KX514352
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucuacgcccaccagaacaccaaguucacccccgucggcgucguccagggcggcgaguccgcccaccgcuccgagccccagcaguggguccuccccggcuacuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16967 - RNA, 1617 nt, Artificial Sequence
  derived and/or modified sequence opt2 from VP1__Norovirus_and/or_Norovirus-like__KX514339
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaguccggcaacaccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16968 - RNA, 1617 nt, Artificial Sequence
  derived and/or modified sequence opt2 from VP1__Norovirus_and/or_Norovirus-like__KR904238
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccccuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccuacggcuacuuccgcuucgacuccugggucaaccaguucuacacccucgcccccaugggcaacggcaccggccgccgccgcuga

SEQ ID NO: 16969 - RNA, 1617 nt, Artificial Sequence
  derived and/or modified sequence opt2 from VP1__Norovirus_and/or_Norovirus-like__KJ710245
augaagauggccuccuccgacgccaaccccuccgacggcuccaccgccaaccucguccccgaggucaacgacgaggucauggcccucgagcccgucgucggcgccgcccucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacgcccgcaacaacuucuaccacuacaaccaguccaacgaguccaccaucaagcucaucgccaugcucuacaccccccuccgcgccaacaacgccggcgacgacgucuucaccgucuccugccgcguccucacccgccccucccucgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgccguccagccccagaacggccgcugcaccaccgacggcguccuccucggcaccacccagcucucccccgucaacaucugcaccuuccgcggcgacgucacccacaccaccggcucccacaacuacaccaugaaccucgccucccagaaccgcuccaacuacgaccccaccgaggagauccccgccccccucggcacccccgacuucgucggcaagauccagggcgcccucacccagaccacccgcgccgacggcuccacccgcggccacaaggccaccgucuacaccggcuccgccgacuucacccccaagcucggccgcguccaguucgccaccgacaccgaccacgacuucgacaccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggagugggucgcccacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16970 - RNA, 1617 nt, Artificial Sequence
  derived and/or modified sequence opt2 from VP1__Norovirus_and/or_Norovirus-like__KX514298
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucauccagggcggcgaguccgcccaccgcuccgagccccagcaguggguccuccccuccuacuccggccgcgacauccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16971 - RNA, 1617 nt, Artificial Sequence
  derived and/or modified sequence opt2 from VP1__Norovirus_and/or_Norovirus-like__KX514269
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucaccggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccaguccggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16972 - RNA, 1617 nt, Artificial Sequence
  derived and/or modified sequence opt2 from VP1__Norovirus_and/or_Norovirus-like__KX514179
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16973 - RNA, 1617 nt, Artificial Sequence
  derived and/or modified sequence opt2 from VP1__Norovirus_and/or_Norovirus-like__KX514289
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccaguccggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16974 - RNA, 1617 nt, Artificial Sequence
  derived and/or modified sequence opt2 from VP1__Norovirus_and/or_Norovirus-like__KX514288
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccaguccggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16975 - RNA, 1617 nt, Artificial Sequence
  derived and/or modified sequence opt2 from VP1__Norovirus_and/or_Norovirus-like__KX514268
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccacggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16976 - RNA, 1617 nt, Artificial Sequence
  derived and/or modified sequence opt2 from VP1__Norovirus_and/or_Norovirus-like__JX459653
augaagauggccuccuccgaccccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaagcucaagcuccgccccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16977 - RNA, 1617 nt, Artificial Sequence
  derived and/or modified sequence opt2 from VP1__Norovirus_and/or_Norovirus-like__KX514359
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgaguccccccagcgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16978 - RNA, 1617 nt, Artificial Sequence
  derived and/or modified sequence opt2 from VP1__Norovirus_and/or_Norovirus-like__KX514296
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccggcaccaccaacgaccucgacgcccaccagaacaccaaguucacccccgucggcgucguccagggcggcgaguccccccagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16979 - RNA, 1617 nt, Artificial Sequence
  derived and/or modified sequence opt2 from VP1__Norovirus_and/or_Norovirus-like__KX514284
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgaguccccccagcgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16980 - RNA, 1617 nt, Artificial Sequence
  derived and/or modified sequence opt2 from VP1__Norovirus_and/or_Norovirus-like__KX514245
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgaguccccccagcgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucacccacaccggccagcacgaccucgucaucccccccaacggcuacuuccgcuucgacuccugggucaaccaguucuacacccucgcccccaugggcaacggcaccggccgcaagcgcuga

SEQ ID NO: 16981 - RNA, 1617 nt, Artificial Sequence
  derived and/or modified sequence opt2 from VP1__Norovirus_and/or_Norovirus-like__KX514327
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacuccggcaacuccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16982 - RNA, 1617 nt, Artificial Sequence
  derived and/or modified sequence opt2 from VP1__Norovirus_and/or_Norovirus-like__KX514301
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16983 - RNA, 1617 nt, Artificial Sequence
  derived and/or modified sequence opt2 from VP1__Norovirus_and/or_Norovirus-like__KX514299
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgaguccccccagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16984 - RNA, 1617 nt, Artificial Sequence
  derived and/or modified sequence opt2 from VP1__Norovirus_and/or_Norovirus-like__KX514277
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgagcucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16985 - RNA, 1617 nt, Artificial Sequence
  derived and/or modified sequence opt2 from VP1__Norovirus_and/or_Norovirus-like__KX514213
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccguccaggagaugaccaacucccgcuuccccgccacccucgacaagcucuucaccggccccuccuccaaccucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgaguccccccagcgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16986 - RNA, 1617 nt, Artificial Sequence
  derived and/or modified sequence opt2 from VP1__Norovirus_and/or_Norovirus-like__KT033903
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcggcgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagguccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccguccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16987 - RNA, 1617 nt, Artificial Sequence
  derived and/or modified sequence opt2 from VP1__Norovirus_and/or_Norovirus-like__HM625866
augaagauggccuccuccgacgccaaccccuccgacggcuccaccgccaaccucguccccgaggucaacaacgaggucauggcccucgagcccgucgucggcgccgccuccgccgcccccgucgccggccagcagaacgucaucgaccccuggauccgcaacaacuucguccaggcccccggcggcgaguucaccgagucccccaccaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucguccccgccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgcccccgucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16988 - RNA, 1617 nt, Artificial Sequence
  derived and/or modified sequence opt2 from VP1__Norovirus_and/or_Norovirus-like__KX514319
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaccccggcggcuccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16989 - RNA, 1617 nt, Artificial Sequence
  derived and/or modified sequence opt2 from VP1__Norovirus_and/or_Norovirus-like__KX514311
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaugaucgacggcguccuccucggcaccacccagcucucccccgucaacaucugcaccuuccgcggcgacgucacccaccccggcggcuccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16990 - RNA, 1617 nt, Artificial Sequence
  derived and/or modified sequence opt2 from VP1__Norovirus_and/or_Norovirus-like__KX514266
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaccccggcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16991 - RNA, 1617 nt, Artificial Sequence
  derived and/or modified sequence opt2 from VP1__Norovirus_and/or_Norovirus-like__KX514235
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgaguccccccagcgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16992 - RNA, 1617 nt, Artificial Sequence
  derived and/or modified sequence opt2 from VP1__Norovirus_and/or_Norovirus-like__KX354115
augaagauggccuccuccgacgccaaccccuccgacggcuccgccgccaaccucguccccgaggccaacaacgaggucauggcccucgagcccgucgccggcgccgcccucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccuccggccucucccccucccaggucaccauguuccccuccgucgucgucgacguccgccagcucgagcccguccucaucccccuccccgacguccgcaacaacuucuaccacuacaaccaguccaacgaccccaccaucacccucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacaucauccacaucaccggcucccacaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuacaccggcuccgccgacuucauccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16993 - RNA, 1617 nt, Artificial Sequence
  derived and/or modified sequence opt2 from VP1__Norovirus_and/or_Norovirus-like__KM272334
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcaccuacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacgcccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacucccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgucccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccagggcgccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16994 - RNA, 1617 nt, Artificial Sequence
  derived and/or modified sequence opt2 from VP1__Norovirus_and/or_Norovirus-like__KX354116
augaagauggccuccuccgacgccaaccccuccgacggcuccgccgccaaccucguccccgaggccaacaacgaggucauggcccucgagcccgucgccggcgccgcccucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgccggccucucccccucccaggucaccauguuccccuccgucgucgucgacguccgccagcucgagcccguccucaucccccuccccgacguccgcaacaacuucuaccacuacaaccaguccaacgaccccaccaucacccucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacaucauccacaucaccggcucccacaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuacaccggcuccgccgacuucauccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 16995 - RNA, 1617 nt, Artificial Sequence
  derived and/or modified sequence opt2 from VP1__Norovirus_and/or_Norovirus-like__KX514172
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16996 - RNA, 1617 nt, Artificial Sequence
  derived and/or modified sequence opt2 from VP1__Norovirus_and/or_Norovirus-like__KX354114
augaagauggccuccuccgacgccaaccccuccgacggcuccgccgccaaccucguccccgaggccaacaacgaggucauggcccucgagcccgucgccggcgccgcccucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccuccggccucucccccucccaggucaccauguuccccuccgucgucgucgacguccgccagcucgagcccguccucaucccccuccccgacguccgcaacaacuucuaccacuacaaccaguccaacgaccccaccaucacccucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacaucauccacaucaccggcucccacaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuacaccggcuccgccgacuucauccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16997 - RNA, 1617 nt, Artificial Sequence
  derived and/or modified sequence opt2 from VP1__Norovirus_and/or_Norovirus-like__KX514295
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucaaccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16998 - RNA, 1617 nt, Artificial Sequence
  derived and/or modified sequence opt2 from VP1__Norovirus_and/or_Norovirus-like__KX514242
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgaguccccccagcgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 16999 - RNA, 1617 nt, Artificial Sequence
  derived and/or modified sequence opt2 from VP1__Norovirus_and/or_Norovirus-like__KX514224
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgucuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgaguccccccagcgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17000 - RNA, 1617 nt, Artificial Sequence
  derived and/or modified sequence opt2 from VP1__Norovirus_and/or_Norovirus-like__KX514262
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccgccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgagucccccaagggcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17001 - RNA, 1617 nt, Artificial Sequence
  derived and/or modified sequence opt2 from VP1__Norovirus_and/or_Norovirus-like__KX354139
augaagauggccuccuccgacgccaaccccuccgacggcuccgccgccaaccucguccccgaggccaacaacgaggucauggcccucgagcccgucgccggcgccgcccucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccaccggccucucccccucccaggucaccauguuccccuccgucgucgucgacguccgccagcucgagcccgucaugaucccccuccccgacguccgcaacaacuucuaccacuacaaccaguccaacgaccccaccaucacccucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcaggucaucuucauccgcuccaccaugcccggcuccuccggcuaccccaacauggaccucgacugccuccucccccaggaguggguccaguacuucuaccaggaggccgcccccgcccaguccgacgucgccaugauccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17002 - RNA, 1617 nt, Artificial Sequence
  derived and/or modified sequence opt2 from VP1__Norovirus_and/or_Norovirus-like__KX514215
augaagauggccuccaacgacgucaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccggccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucaaccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccguccaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccaacgaccucgacgcccaccagaacaccaaguucacccccgucggcgucguccagggcggcgaguccccccagcgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17003 - RNA, 1617 nt, Artificial Sequence
  derived and/or modified sequence opt2 from VP1__Norovirus_and/or_Norovirus-like__KX514367
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccgacuacgcccccaagcucggccgcguccaguucgagaccgacaccaccaacgaccucgacgcccaccagaacaccaaguucacccccgucggcgucguccagggcggcgagucccccaagggcuccgagccccagcaguggguccuccccucccacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17004 - RNA, 1617 nt, Artificial Sequence
  derived and/or modified sequence opt2 from VP1__Norovirus_and/or_Norovirus-like__KX514243
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaaccucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacuccuacgaccccaccgaggagacccccgccccccucggcacccccgacuucgucggcaagauccacggcaugcucacccagaccacccagggcuccggcuccacccgcgcccaccgcgccaccgucuacgucggcggcgccgaguucacccccaagcucggcaagguccaguucaagaccgagaccgaccacgaccucuccauccgccagaacaccaaguucacccccgucggcgucguccagggcggcgaguccccccagcgcuccgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17005 - RNA, 1617 nt, Artificial Sequence
  derived and/or modified sequence opt2 from VP1__Norovirus_and/or_Norovirus-like__KX353996
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgaccgccuccccccccaggagcgcguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17006 - RNA, 1617 nt, Artificial Sequence
  derived and/or modified sequence opt2 from VP1__Norovirus_and/or_Norovirus-like__DQ078820
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucggccccucccaggucaccauguucccccacaucaucgucgacguccgccagcucgagcccguccucaucccccuccucgacguccgcaacaaccucuaccacuacaaccaguccaacgaccccaccaucaagcucaucgccaugcucuacaccccccuccgcgccaacaacgccggcgaggucgucuucaccgucuccugccgcguccucacccgccccucccccgacuucgacuucaucuuccucgucccccccaccgucgagucccgcaccaagcccuucaccguccccauccucaccgccgaggagaugaccaacucccgcuuccccaccccccucggcaagcucuucaccggccccuccuccgccuucgucguccagccccagaacggccgcugcgccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcggcguccaguucaccaccgacaccaacaacgacuucgagaccggccagaacaccaaguucacccccgucggcgucauccaggacggcaacuccacccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacgccggccgcguccucuucgagugcaagccccacaaguccggcuacgucaccgucgcccacaccggccagcacgaccucgucaucccccccaacggcuacuuccgcuucgacuccugggucaaccaguucugcacccucgcccccaugggcaacggcaccggccgccgccgcuga

SEQ ID NO: 17007 - RNA, 1617 nt, Artificial Sequence
  derived and/or modified sequence opt2 from VP1__Norovirus_and/or_Norovirus-like__AB933738
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucuucccccucgcccgcaaggucaagggcuacgccggcggcuucgagguccaggucauccucgccggcaaggccuuccccgccggcaagaucaucuucgccgccuccccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgccgcgacggcuccacccgcggccacaaggccaccgucuacaccggcuccgccgacuucucccccaagcucggccgcguccaguucgccaccgacaccgacaacgacuucgacacccaccagaacaccaaguucacccccgucggcgucauccaggacggcggcaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17008 - RNA, 1617 nt, Artificial Sequence
  derived and/or modified sequence opt2 from VP1__Norovirus_and/or_Norovirus-like__EU780734
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccauccacuucacccaguccugggccgucuucaacuccccccucauccaggccaugacccucaagcucgccaagacccgcgacuccccccaguccgucgucguccaggacggcuccaccacccaccagaacgagccccagcaguggguccuccccgacuacuccggccgcgacuccuacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 17009 - RNA, 1617 nt, Artificial Sequence
  derived and/or modified sequence opt2 from VP1__Norovirus_and/or_Norovirus-like__KP064096
auggccuccaaggacgcccccaccaacauggacggcaccuccggcgccggccagcucguccccgaggccaacaccgccgagcccaucuccauggagcccgucgccggcgccgucaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaagguccgcguccuccucgccggcaacgccuucaccgccggcaagaucaucaucuccugcaucccccccggcuucgucgcccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcauccucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugauggucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaccacccaguucaacaccggcgacgucaucaagcagaucaacgucaagcaggaguccgccuucgccccccaccucggcaccauccaggccgacggccucuccgacgucuccgucaacaccaacaugaucgccaagcucggcugggucucccccgucuccgacggccacaagcgcgacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgacggcuucaugaccugcguccccaacaccuccggcaccggcccccagacccuccccaucaacggcgucuucgucuucgucuccugggucucccgcuucuaccagcucaagcccgucggcaccgccggccccgcccgccgccucuga

SEQ ID NO: 17010 - RNA, 1617 nt, Artificial Sequence
  derived and/or modified sequence opt2 from VP1__Norovirus_and/or_Norovirus-like__KC473548
augaugauggccuccaaggacgcccccaccaacauggacggcaccuccggcgccggccagcucguccccgaggccaacaccgccgagccccuccccaucaagcccgucgccggcgccgccaccgccgucgccaccgccggccaggucaacaugaucgaccccuggaucaugaacaacuucguccaggccccccagggcgaguucaccaucucccccaacaacacccccggcgacauccucuucgaccuccagcucggcccccaccucaaccccuuccucgcccaccucucccgcauguacaacggcugggucggcaacaugcagguccgcaucaugcucgccggcaacgccuucuccgccggcaagaucaucgucugcugcaucccccccggcuucuccucccaguccaucuccaucgcccaggccaccauguucccccacgucaucgccgacguccgcguccucgagcccaucgacgucccccucgacgacguccgcaacguccucuuccacaacaacgacaacccccagaccaugcgccuccucugcaugcucuacaccccccuccgcuccggcggcaccuccuccggcaccgaccccuucgucaucgccggccgcguccucaccugccccacccccgacuucuccuuccucuuccucgucccccccgacaucgagcagcgcaccaagcccuucuccguccccaacauccccaugaaccucauguccaacucccgcgucuccaugcucaucgacggcaugauggucuccaacgaccagaaccaggucccccaguuccagaacggccgcgucacccucgacggccagcuccagggcaccaccaccgucuccgccgccugcgucgcccgcaugcgcggccgcaucuucaacaacaacggcaacuacggcgucaaccucaccgagcucgacggcaaccccuaccacgccuucgacucccccgccccccucggcuuccccgacuucggcaacugcgaccuccacaugaccuucgucaagaucaaccccaacgagcucuccuccggcgaccccuccggcaaggucgucauccgcuccuacgacgccaccuucgccccccaccucggcaccgucaagcucgagaacgacgacgagcucgcccgcuucgucggcaaggaggucguccucgagcucaccugggucuccaaccgcgagggcgccacccucaaccucugggccguccccaacuacggcuccucccucacccaggccucccagcucgccccccccaucuacccccccggcuucggcgaggccaucgucuacuucaccuccaccuuccccaccgucuccaaccccaagguccccugcacccucccccaggaguucgucucccacuucgucaacgagcaggcccccacccgcggcgacgccgcccuccuccacuacgucgaccccgacacccaccgcaaccucggcgaguucaagauguaccccgagggcuacaugaccugcguccccaacgccggcggcggcccccagacccuccccaucaacggcgucuucgucuucaucuccugggucucccgcuacuaccagcucaagcccgucggcaccgccggcgccgcccgccgccucuga

SEQ ID NO: 17011 - RNA, 1617 nt, Artificial Sequence
  derived and/or modified sequence opt2 from VP1__Norovirus_and/or_Norovirus-like__AB684698
auggccuccaaggacgcccccuccaacauggacggcaccuccggcgccggccagcucguccccgaggccaacaccgccgagcccaucaacauggaguccgucgucggcgccgccaccgccaccgccaccgccggccaggucaaccucaucgaccccuggaucaugaacaacuacguccaggccccccagggcgaguucaccaucucccccaacaacacccccggcgacguccucuucgaccuccagcucggcccccaccucaaccccuuccucucccaccucucccgcauguacaacggcugggucggcaacaugaagguccgcgucaugcucgccggcaacgccuucuccgccggcaagaucaucaucugcugcaucccccccggcuucaccucccaguccaucuccaucgcccaggccaccauguucccccacgucaucgccgacguccgcguccucgagcccaucgacgucccccucgacgacguccgcaacguccucuuccacaacaacgacaacgcccagaccaugcgccuccucugcaugcucuacaccccccuccgcaccggcgccuccuccuccggcuccgaccccuucgucaucgccggccgcguccucaccugccccacccaggacuucaacuuccucuuccucgucccccccgacgucgagcagaagaccaagcccuucuccguccccaacaucccccucaaccucauguccaacucccgcguccccgcccucaucgacggcaugaccgucuccuccgaccagaaccaggucguccaguuccagaacggccgcgucacccucgacggccagcuccagggcaccaccgccgucuccgccuccugcgucgccaagauccgcggccgcaucuucuccaacgccucccacuacggcaucaaccucaccgaggucgacggcacccaguaccacgccuucgacucccccgccccccucggcuuccccgacuucggcaacugcgacuggcacgucaccggcaccaaggccucccagggcgaccuccagaccgacaaccccaccaucuccggcaccaucaaguccuacgaguccuccuucgccccccaccucggcaccguccgcaucgagggcgacgacaacgagcucgcccgcuucaacggcaaggacguccuccucaaccucaccugguucucccagcgcaacggcucccagcucaaccucuggaccauccccuccuacggcuccaaccucaccgaggccucccagcucgccccccccaucuacccccccggcuucggcgaggccaucgucuacuucaccuccaccuuccccgccaucucccgccccuccguccccugcaccaugccccaggaguucgucucccacuucgucaacgagcaggcccccacccgcggcgaggccgcccuccuccacuaccucgaccccgacacccaccgcaaccucggcgaguucaagauguaccccgagggcuucuucaccugcguccccaacgccggcggcuccggcccccagacccuccccaucaacggcgucuucgucuucgucuccugggucucccgcuacuaccagcucaagcccgucggcaccgucggcaugacccgccgccucuga

SEQ ID NO: 17012 - RNA, 1617 nt, Artificial Sequence
  derived and/or modified sequence opt2 from VP1__Norovirus_and/or_Norovirus-like__AF538679
augaagauggccuccaaggacgcccccaccaacauggacggcaccuccggcgccggccagcucguccccggcgccaacaccgccgagccccuccccaucaagcccgucgccggcgccgccaccgccgucgccaccgccggccaggucaacaugaucgaccccuggaucaugaacaacuucguccaggccccccagggcgaguucaccaucucccccaacaacacccccggcgacauccucuucgaccuccagcucggcccccaccucaaccccuuccucgcccaccucucccgcauguacaacggcugggucggcaacaugcagguccgcaucaugcucgccggcaacgccuucuccgccggcaagaucaucgucugcugcaucccccccggcuucuccucccaguccaucuccaucgcccaggccaccauguucccccacgucaucgccgacguccgcguccucgagcccaucgacgucccccucgacgacguccgcaacguccucuuccacaacaacgacaacccccagaccaugcgccuccucugcaugcucuacaccccccuccgcuccggcggcgccuccuccggcaccgaccccuucgucaucgccggccgcguccucaccugccccacccccgacuucuccuuccucuuccucgucccccccgacaucgagcagcgcaccaagcccuucuccguccccaacauccccaugaaccucauguccaacucccgcguccccaugcucaucgacggcaugauggucuccaacgaccagaaccaggucccccaguuccagaacggccgcgucacccucgacggccagcuccagggcaccaccaccgucuccgccgccugcaucgcccgcaugcgcggccgcaucuucaacaacaacggcaacuacggcgucaaccucgccgagcucgacggcaaccccuaccacgccuucgacucccccgccccccucggcuuccccgacuucggcaacugcgaccuccacaugaccuucgucaagaucaaccccaccgagcucuccaccggcgaccccuccggcaaggucgucauccacuccuacgacgccaccuucgccccccaccucggcaccgucaagcucgaggacaacaacgagcucgaccaguucgucggcaaggaggucguccucgagcucaccugggucuccaaccgcaccggcgccacccucaaccucugggccguccccaacuacggcuccaaccucacccaggccucccagcucgccccccccaucuacccccccggcuucggcgaggccaucgucuacuucaccuccaccuuccccaccgucuccaaccccaagguccccugcacccucccccaggaguucgucucccacuucgucaacgagcaggcccccacccgcggcgacgccgcccuccuccacuacgucgaccccgacacccaccgcaaccucggcgaguucaagauguaccccgagggcuacaugaccugcguccccaacgccggcggcggcccccagacccuccccaucaacggcgucuucgucuucaucuccugggucucccgcuacuaccagcucaagcccgucggcaccgccggcgccgcccgccgccucuga

SEQ ID NO: 17013 - RNA, 1617 nt, Artificial Sequence
  derived and/or modified sequence opt2 from VP1__Norovirus_and/or_Norovirus-like__JQ743332
augaugauggccuccaaggacgccucccaguccgccgacggcgccuccggcgccggccagcucguccccgaggucaacaccgccgacccccuccccauggagcccgucgccggccccaccaccgccgucgccaccgccggccaggucaacaugaucgaccccuggaucgucaacaacuucguccaguccccccagggcgaguucaccaucucccccaacaacacccccggcgacauccucuucgaccuccagcucggcccccaccucaaccccuuccucucccaccucucccagauguacaacggcugggucggcaacaugcgcguccgcauccuccucgccggcaacgccuucuccgccggcaagaucaucgucugcugcgucccccccggcuucaccuccuccucccucaccaucgcccaggccacccucuucccccacgucaucgccgacguccgcacccucgagcccaucgagaugccccucgaggacguccgcaacguccucuaccacaccaacgacaaccagcccaccaugcgccucgucugcaugcucuacaccccccuccgcaccggcggcggcuccggcaacuccgacuccuucgucgucgccggccgcguccucaccgcccccuccuccgacuucuccuuccucuuccucgucccccccaccaucgagcagaagacccgcgccuucaccguccccaacaucccccuccagacccucuccaacucccgcuuccccucccucauccagggcaugauccucucccccgacgccucccaggucguccaguuccagaacggccgcugccucaucgacggccagcuccucggcaccacccccgccaccuccggccagcucuuccgcguccgcggcaagaucaaccagggcgcccgcacccucaaccucaccgaggucgacggcaagcccuucauggccuucgacucccccgcccccgucggcuuccccgacuucggcaagugcgacuggcacaugcgcaucuccaagacccccaacaacaccuccuccggcgaccccaugcgcuccgucuccguccagaccaacguccagggcuucgucccccaccucggcuccauccaguucgacgaggucuucaaccaccccaccggcgacuacaucggcaccaucgaguggaucucccagcccuccaccccccccggcaccgacaucaaccucugggagauccccgacuacggcuccucccucucccaggccgccaaccucgccccccccgucuucccccccggcuucggcgaggcccucgucuacuucgucuccgccuuccccggccccaacaaccgcuccgcccccaacgacguccccugccuccucccccaggaguacaucacccacuucgucuccgagcaggcccccaccaugggcgacgccgcccuccuccacuacgucgaccccgacaccaaccgcaaccucggcgaguucaagcucuaccccggcggcuaccucaccugcguccccaacggcgucggcgccggcccccagcagcucccccucaacggcgucuuccucuucgucuccugggucucccgcuucuaccagcucaagcccgucggcaccgccuccaccgcccgcuga

SEQ ID NO: 17014 - RNA, 1617 nt, Artificial Sequence
  derived and/or modified sequence opt2 from VP1__Norovirus_and/or_Norovirus-like__GQ856470
augaugauggccuccaaggacgcccccaccaacauggacggcaccuccggcgccggccagcucguccccgaggucuccaccgccgagcccaucuccauggagcccgucgccggcgccgccaccgccgccgccaccgccggccaggucaacaugaucgaccccuggaucauguccaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaagguccgcguccuccucgccggcaacgccuucaccgccggcaagaucaucaucuccugcgucccccccggcuucgccgcccagaacgucuccaucgcccaggccaccauguucccccacgucaucgccgacguccgcguccucgagcccaucgaggucccccucgaggacguccgcaacguccucuuccacaacaacgacuccacccccaccaugcgccucaucugcaugcucuacaccccccuccgcgccuccggcuccuccuccggcaccgaccccuucgucaucgccggccgcguccucaccugccccucccccgacuucaacuuccucuuccucgucccccccaacgucgagcagaagaccaagcccuucuccguccccgaccucccccucaacguccucuccaacucccgcguccccucccucaucaaguccaugauggucucccaggaccacggccagaugguccaguuccagaacggccgcgucacccucgacggccagcuccagggcaccacccccaccuccgccucccagcucugcaagauccgcggcaccgucuaccacgccaccggcggccagggccucaaccucaccgagaucgacggcacccccuaccacgccuucgagucccccgcccccaucggcuuccccgaccucggcgagugcgacuggcacaucaacgccucccccgccaacgccuucaccgacggcuccaucauccaccgcaucgacgucguccaggaccccaccuucgccccccaccucggcaccauccacuacaccaacgccaacuacgacgccaacgucucccucaucugcucccucgaguggcucuccccccccuccggcggcgcccucaaggccaaccccugggccaucccccgcuacggcuccacccucaccgaggccgcccagcucgccccccccaucuacccccccggcuucggcgaggccaucgucuucuucauguccgacuuccccaucgccaacggcuccgacggccucuccguccccugcaccaucccccaggaguucgucacccacuucgucaacgagcaggcccccacccgcggcgaggccgcccuccuccacuacgucgaccccgacacccaccgcaaccucggcgaguucaagcucuaccccgagggcuucaugaccugcguccccaacuccuccggcuccggcccccagacccuccccaucaacggcgucuucaccuucaucuccugggucucccgcuucuaccagcucaagcccgucggcaccaccggccccguccgccgccucuga

SEQ ID NO: 17015 - RNA, 1617 nt, Artificial Sequence
  derived and/or modified sequence opt2 from VP1__Norovirus_and/or_Norovirus-like__JN603244
augaugauggccuccaaggacgcccccaccaacauggacggcaccuccggcgccggccagcucguccccgaggucuccaccgccgagcccaucuccauggagcccgucgccggcgccgccaccgccgccgccaccgccggccaggucaacaugaucgaccccuggaucauguccaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaagguccgcguccuccucgccggcaacgccuucaccgccggcaagaucaucaucuccugcgucccccccggcuucgccgcccagaacgucuccaucgcccaggccaccauguucccccacgucaucgccgacguccgcguccucgagcccaucgaggucccccucgaggacguccgcaacguccucuuccacaacaacgacuccacccccaccaugcgccucaucugcaugcucuacaccccccuccgcgccuccggcuccuccuccggcaccgaccccuucgucaucgccggccgcguccucaccugccccucccccgacuucaacuuccucuuccucgucccccccaacgucgagcagaagaccaagcccuucuccguccccaaccucccccucaacguccucuccaacucccgcguccccucccucaucaaguccaugauggucucccaggaccacggccagaugguccaguuccagaacggccgcgucacccucgacggccagcuccagggcaccacccccaccuccgccucccagcucugcaagauccgcggcaccgucuaccacgccaccggcggccagggccucaaccucaccgagaucgacggcacccccuaccacgccuucgagucccccgcccccaucggcuuccccgaccucggcgagugcgacuggcacaucaacgccucccccgccaacgccuucaccgacggcuccaucauccaccgcaucgacgucgcccaggacuccaccuucgccccccaccucggcaccauccacuacaccaacgccgacuacaacgccaacgucggccucaucugcucccucgaguggcucuccccccccuccggcggcgcccccaaggucaaccccugggccaucccccgcuacggcuccacccucaccgaggccgcccagcucgccccccccaucuacccccccggcuucggcgaggccaucgucuucuucauguccgacuuccccaucgccaacggcuccgacggccucuccguccccugcaccaucccccaggaguucgucacccacuucgucaacgagcaggcccccacccgcggcgaggccgcccuccuccacuacgucgaccccgacacccaccgcaaccucggcgaguucaagcucuaccccgagggcuucaugaccugcguccccaacuccuccggcuccggcccccagacccuccccaucaacggcgucuucaccuucaucuccugggucucccgcuucuaccagcucaagcccgucggcaccaccggccccguccgccgccucuga

SEQ ID NO: 17016 - RNA, 1617 nt, Artificial Sequence
  derived and/or modified sequence opt2 from VP1__Norovirus_and/or_Norovirus-like__AB078335
augaugauggccuccaaggacgccccccaguccgccgacggcgccuccggcgccggccagcucguccccgaggucaacaccgccgacccccuccccauggagcccgucgccggccccaccaccgccgucgccaccgccggccaggucaacaugaucgaccccuggaucgucaacaacuucguccaguccccccagggcgaguucaccaucucccccaacaacacccccggcgacauccucuucgaccuccagcucggcccccaccucaaccccuuccucucccaccucucccagauguacaacggcugggucggcaacaugcgcguccgcauccuccucgccggcaacgccuucuccgccggcaagaucaucgucugcugcgucccccccggcuucaccuccuccucccucaccaucgcccaggccacccucuucccccacgucaucgccgacguccgcacccucgagcccaucgagaugccccucgaggacguccgcaacguccucuaccacaccaacgacaaccagcccaccaugcgccucgucugcaugcucuacaccccccuccgcaccggcggcggcuccggcaacuccgacuccuucgucgucgccggccgcguccucaccgcccccuccuccgacuucuccuuccucuuccucgucccccccaccaucgagcagaagacccgcgccuucaccguccccaacaucccccuccagacccucuccaacucccgcuuccccucccucauccagggcaugauccucucccccgacgccucccaggucguccaguuccagaacggccgcugccucaucgacggccagcuccucggcaccacccccgccaccuccggccagcucuuccgcguccgcggcaagaucaaccagggcgcccgcacccucaaccucaccgaggucgacggcaagcccuucauggccuucgacucccccgcccccgucggcuuccccgacuucggcaagugcgacuggcacaugcgcaucuccaagacccccaacaacaccuccuccggcgaccccaugcgcuccgucuccguccagaccaacguccagggcuucgucccccaccucggcuccauccaguucgacgaggucuucaaccaccccaccggcgacuacaucggcaccaucgaguggaucucccagcccuccaccccccccggcaccgacaucaaccucugggagauccccgacuacggcuccucccucucccaggccgccaaccucgccccccccgucuucccccccggcuucggcgaggcccucgucuacuucgucuccgccuuccccggccccaacaaccgcuccgcccccaacgacguccccugccuccucccccaggaguacaucacccacuucgucuccgagcaggcccccaccaugggcgacgccgcccuccuccacuacgucgaccccgacaccaaccgcaaccucggcgaguucaagcucuaccccggcggcuaccucaccugcguccccaacggcgucggcgccggcccccagcagcucccccucaacggcgucuuccucuucgucuccugggucucccgcuucuaccagcucaagcccgucggcaccgccuccaccgcccgcuga

SEQ ID NO: 17017 - RNA, 1617 nt, Artificial Sequence
  derived and/or modified sequence opt2 from VP1__Norovirus_and/or_Norovirus-like__GU299761
augaugauggccuccaaggacgcccccaccaacauggacggcaccuccggcgccggccagcucguccccgaggccaacaccgccgagccccuccccaucaagcccgucgccggcgccgccaccgccgucgccaccgccggccaggucaacaugaucgaccccuggaucaugaacaacuucguccaggccccccagggcgaguucaccaucucccccaacaacacccccggcgacauccucuucgaccuccagcucggcccccaccucaaccccuuccucgcccaccucucccgcauguacaacggcugggucggcaacaugcagguccgcaucaugcucgccggcaacgccuucuccgccggcaagaucaucgucugcugcaucccccccggcuucuccucccaguccaucuccaucgcccaggccaccauguucccccacgucaucgccgacguccgcguccucgagcccaucgacgucccccucgacgacguccgcaacguccucuuccacaacaacgacaacccccagaccaugcgccuccucugcaugcucuacaccccccuccgcuccggcggcaccuccuccggcaccgaccccuucgucaucgccggccgcguccucaccugccccacccccgacuucuccuuccucuuccucgucccccccgacaucgagcagcgcaccaagcccuucuccguccccaacauccccaugaaccucauguccaacucccgcgucuccaugcucaucgacggcaugauggucuccaacgaccagaaccaggucccccaguuccagaacggccgcgucacccucgacggccagcuccagggcaccaccaccgucuccgccgccugcgucgcccgcaugcgcggccgcaucuucaacaacaacggcaacuacggcgucaaccucaccgagcucgacggcaaccccuaccacgccuucgacucccccgccccccucggcuuccccgacuucggcaacugcgaccuccacaugaccuucgucaagaucaaccccaacgagcucuccuccggcgaccccuccggcaaggucgucauccacuccuacgacgccaccuucgccccccaccucggcaccgucaagcucgagaacgacgacgagcucgcccgcuucgucggcaaggaggucguccucgagcucaccugggucuccaaccgcgagggcgccacccucaaccucugggccguccccaacuacggcuccucccucacccaggccucccagcucgccccccccaucuacccccccggcuucggcgaggccaucgucuacuucaccuccaccuuccccaccgucuccaaccccaagguccccugcacccucccccaggaguucgucucccacuucgucaacgagcaggcccccacccgcggcgacgccgcccuccuccacuacgucgaccccgacacccaccgcaaccucggcgaguucaagauguaccccgagggcuacaugaccugcguccccaacgccggcggcggcccccagacccuccccaucaacggcgucuucgucuucaucuccugggucucccgcuacuaccagcucaagcccgucggcaccgccggcgccgcccgccgccucuga

SEQ ID NO: 17018 - RNA, 1617 nt, Artificial Sequence
  derived and/or modified sequence opt2 from VP1__Norovirus_and/or_Norovirus-like__AJ277610
augaugauggccuccaagggcgccccccaguccgccgacggcuccuccggcgccggccagcucguccccgaggucaacaccgccgacccccuccccauggagcccgucgccggccccaccaccgccgucgccaccgccggccaggucaacaugaucgaccccuggaucgucaacaacuucguccaguccccccagggcgaguucaccaucucccccaacaacacccccggcgacauccucuucgaccuccagcucggcccccaccucaaccccuuccucucccaccucucccagauguacaacggcugggucggcaacaugcgcguccgcauccuccucgccggcaacgccuucuccgccggcaagaucaucgucugcugcgucccccccggcuucaccuccuccucccucaccaucgcccaggccacccucuucccccacgucaucgccgacguccgcacccucgagcccaucgagaugccccucgaggacguccgcaacguccucuaccacaccaacgacucccagcccaccaugcgccucgucugcaugcucuacaccccccuccgcaccggcggcggcuccggcaacuccgacuccuucgucgucgccggccgcguccucaccgcccccuccuccgacuucuccuuccucuuccucgucccccccaccaucgagcagaagacccgcgccuucaccguccccaacaucccccuccagacccucuccaacucccgcuuccccucccucauccagggcaugauccucucccccgacgccucccaggucguccaguuccagaacggccgcugccucaucgacggccagcuccucggcaccacccccgccaccuccggccagcucuuccgcguccgcggcaagaucaaccagggcgcccgcacccucaaccucaccgaggucgacggcaagcccuucauggccuucgacucccccgcccccgucggcuuccccgacuucggcaagugcgacuggcacaugcgcgucuccaagacccccaacaacaccuccuccggcgaccccaugcgcuccgucuccguccagaccaacguccagggcuucgucccccaccucggcuccauccaguucgacgaggucuucaaccaccccaccggcgacuacaucggcaccaucgaguggaucucccagcccuccaccccccucggcaccgacaucaaccucugggagauccccgacuacggcuccucccucucccaggccgccaaccucgccccccccgucuucccccccggcuucggcgaggcccucgucuacuucgucuccgccuuccccggccccaacaaccgcuccgcccccaacgacguccccugccuccucccccaggaguacaucacccacuucgucuccgagcaggcccccaccaugggcgacgccgcccuccuccacuacgucgaccccgacaccaaccgcaaccucggcgaguucaagcucuaccccggcggcuaccucaccugcguccccaacggcgucggcgccggcccccagcagcucccccucaacggcgucuuccucuucgucuccugggucucccgcuucuaccagcucaagcccgucggcaccgccuccaccgcccgcuga

SEQ ID NO: 17019 - RNA, 1617 nt, Artificial Sequence
  derived and/or modified sequence opt2 from VP1__Norovirus_and/or_Norovirus-like__GQ856462
augaugauggccuccaaggacgcccccaccaacauggacggcaccuccggcgccggccagcucguccccgaggccaacaccgccgagccccuccccaucaagcccgucgccggcgccgccaccgccgucgccaccgccggccaggucaacaugaucgaccccuggaucaugaacaacuucguccaggccccccagggcgaguucaccaucucccccaacaacacccccggcgacauccucuucgaccuccagcucggcccccaccucaaccccuuccucgcccaccucucccgcauguacaacggcugggucggcaacaugcagguccgcaucaugcucgccggcaacgccuucuccgccggcaagaucaucgucugcugcaucccccccggcuucuccucccaguccaucuccaucgcccaggccaccauguucccccacgucaucgccgacguccgcguccucgagcccaucgacgucccccucgacgacguccgcaacguccucuuccacaacaacgacaacccccagaccaugcgccuccucugcaugcucuacaccccccuccgcuccggcggcaccuccuccggcaccgaccccuucgucaucgccggccgcguccucaccugccccacccccgacuucuccuuccucuuccucgucccccccgacaucgagcagcgcaccaagcccuucuccguccccaacauccccaugaaccucauguccaacucccgcgucuccaugcucaucgacggcaugauggucuccaacgaccagaaccaggucccccaguuccagaacggccgcgucacccucgacggccagcuccaggacaccaccaccgucuccgccgccugcgucgcccgcaugcgcggccgcaucuucaacaacaacggcaacuacggcgucaaccucaccgagcucgacggcaaccccuaccacgccuucgacucccccgccccccucggcuuccccgacuucggcaacugcgaccuccacaugaccuucgucaagaucaaccccaacgagcucuccuccggcgaccccuccggcaaggucgucauccacuccuacgacgccaccuucgccccccaccucggcaccgucaagcucgagaacgacgacgagcucgcccgcuucgucggcaaggaggucguccucgagcucaccugggucuccaaccgcgagggcgccacccucaaccucugggccguccccaacuacggcuccucccucacccaggccucccagcucgccccccccaucuacccccccggcuucggcgaggccaucgucuacuucaccuccaccuuccccaccgucuccaaccccaagguccccugcacccucccccaggaguucgucucccacuucgucaacgagcaggcccccacccgcggcgacgccgcccuccuccacuacgucgaccccgacacccaccgcaaccucggcgaguucaagauguaccccgagggcuacaugaccugcguccccaacgccggcggcggcccccagacccuccccaucaacggcgucuucgucuucaucuccugggucucccgcuacuaccagcucaagcccgucggcaccgccggcgccgcccgccgccucuga

SEQ ID NO: 17020 - RNA, 1617 nt, Artificial Sequence
  derived and/or modified sequence opt2 from VP1__Norovirus_and/or_Norovirus-like__AF435807
augaagauggccuccaaggacgccccccaguccgccgacggcgccuccggcgccggccagcucguccccgaggucaacaccgccgacccccuccccauggagcccgucgccggccccaccaccgccgucgccaccgccggccaggucaacaugaccgaccccuggaucgucaacaacuucguccaguccccccagggcgaguucaccaucucccccaacaacacccccggcgacauccucuucgaccuccagcucggcccccaccucaaccccuuccucucccaccucucccagauguacaacggcugggucggcaacaugcgcguccgcauccuccucgccggcaacgccuucuccgccggcaagaucaucgucugcugcgucccccccggcuucaccuccuccucccucaccaucgcccaggccacccucuucccccacgucaucgccgacguccgcacccucgagcccaucgagaugccccucgaggacguccgcaacguccucuaccacaccaacgacaaccagcccaccaugcgccucgucugcaugcucuacaccccccuccgcaccggcggcggcuccggcgacuccgacuccuucgucgucgccggcaagguccucaccgcccccuccuccgacuucuccuuccucuuccucgucccccccaccaucgagcagaagacccgcgccuucaccguccccaacaucccccuccagacccucuccaacucccgcuuccccucccucauccagggcaugauccucucccccgacgccucccaggucguccaguuccagaacggccgcugccucaucgacggccagcuccucggcaccacccccgccaccuccggccagcucuuccgcguccgcggcaagaucaaccagggcgcccgcacccucaaccucaccgaggucgacggcaagcccuucauggccuucgacucccccgcccccgucggcuuccccgacuucggcaagugcgacuggcacaugcgcaucuccaagacccccaacaacaccuccuccggcgaccccaugcgcuccgucuccguccagaccaacguccagggcuucgucccccaccucggcuccauccaguucgacgaggucuucaaccaccccaccggcgacuacaucggcaccaucgaguggaucucccagcccuccaccccccccggcaccgacaucaaccucugggagauccccgacuacggcuccucccucucccaggccgccaaccucgccccccccgucuucccccccggcuucggcgaggcccucgucuacuucgucuccgccuuccccggccccaacaaccgcuccgcccccaacgacguccccugccuccucccccaggaguacaucacccacuucgucuccgagcaggcccccaccaugggcgacgccgcccuccuccacuacgucgaccccgacaccaaccgcaaccucggcgaguucaagcucuaccccggcggcuaccucaccugcguccccaacggcgucggcgccggcccccagcagcucccccucaacggcgucuuccucuucgucuccugggucucccgcuucuaccagcucaagcccgucggcaccgccuccaccgcccgcuga

SEQ ID NO: 17021 - RNA, 1617 nt, Artificial Sequence
  derived and/or modified sequence opt2 from VP1__Norovirus_and/or_Norovirus-like__KX396056
augaugauggccuccaaggacgcccccaccaacauggacggcaccuccggcgccggccagcucguccccgaggccuccaccgccgagcccaucuccauggagcccgucgccggcgccgccaccgccgccgccaccgccggccaggucaacaugaucgaccccuggaucauguccaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaagguccgcguccuccucgccggcaacgccuucaccgccggcaagaucaucaucuccugcgucccccccggcuucgccgcccagaacgucuccaucgcccaggccaccauguucccccacgucaucgccgacguccgcguccucgagcccaucgaggucccccucgaggacguccgcaacguccucuuccacaacaacgacuccacccccaccaugcgccucaucugcaugcucuacaccccccuccgcgccuccggcuccuccuccggcaccgaccccuucgucaucgccggccgcguccucaccugccccucccccgacuucaacuuccucuuccucgucccccccaacgucgagcagaagaccaagcccuucuccguccccaaccucccccucaacguccucuccaacucccgcguccccucccucauccgcuccaugauggucucccaggaccacggccagaugguccaguuccagaacggccgcgucacccucgacggccagcuccagggcaccacccccaccuccgccucccagcucugcaagauccgcggcaccgucuaccacgccaccggcggccagggccucaaccucaccgagaucgacggcacccccuaccacgcccucgagucccccgcccccaucggcuuccccgaccucggcgagugcgacuggcacaucaacgccucccccgccaacgccuucaccgacggcuccaucauccaccgcaucgacgucgcccaggacuccaccuucgccccccaccucggcaccauccacuacaccaacgccaacuacgacgccaacaucucccucaucugcucccucgaguggcucuccccccccuccggcggcgcccccaaggucaaccccugggccaucccccgcuacggcuccacccucaccgaggccgcccagcucgccccccccaucuacccccccggcuucggcgaggccaucgucuucuucauguccgacuuccccaucgccaacggcuccgacggccucuccguccccugcaccaucccccaggaguucgucacccacuucgucaacgagcaggcccccacccgcggcgaggccgcccuccuccacuacgucgaccccgacacccaccgcaaccucggcgaguucaagcucuaccccgagggcuucaugaccugcguccccaacuccuccggcuccggcccccagacccuccccaucaacggcgucuucaccuucaucuccugggucucccgcuucuaccagcucaagcccgucggcaccaccggccccguccgccgccucuga

SEQ ID NO: 17022 - RNA, 1617 nt, Artificial Sequence
  derived and/or modified sequence opt2 from VP1__Norovirus_and/or_Norovirus-like__AB187514
augaugauggccuccaaggacgcccccaccaacauggacggcaccuccggcgccggccagcucguccccgaggccuccaccgccgagcccaucuccauggagcccgucgccggcgccgccaccgccgccgccaccgccggccaggucaacaugaucgaccccuggaucauguccaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaagguccgcguccuccucgccggcaacgccuucaccgccggcaagaucaucaucuccugcgucccccccggcuucgccgcccagaacgucuccaucgcccaggccaccauguucccccacgucaucgccgacguccgcguccucgagcccaucgaggucccccucgaggacguccgcaacguccucuuccacaacaacgacuccacccccaccaugcgccucaucugcaugcucuacaccccccuccgcgccuccggcuccuccuccggcaccgaccccuucgucaucgccggccgcguccucaccugccccucccccgacuucaacuuccucuuccucgucccccccaacgucgagcagaagaccaagcccuucuccguccccaaccucccccucaacguccucuccaacucccgcguccccucccucaucaaguccaugauggucucccaggaccacggccagaugguccacuuccagaucggccgcgucacccucgacggccagcuccagggcaccacccccaccuccgccucccagcucugcaagauccgcggcaccgucuaccacgccaccggcggccagggccucaaccucaccgagaucgacggcacccccuaccacgccuucgagucccccgcccccaucggcuuccccgaccucggcgagugcgacuggcacaucaacgccucccccgccaacgccuucaccgacggcuccaucauccaccgcaucgacgucgcccaggacuccaccuucgccccccaccucggcaccauccacuacaccaacgccaacuacgacgccaacgucucccucaucugcucccucgaguggcucuccccccccuccggcggcgcccccaaggucaaccccugggccaucccccgcuacggcuccacccucaccgaggccgcccagcucgccccccccaucuacccccccggcuucggcgaggccaucgucuucuucauguccgacuuccccaucgccaacggcuccgacggccucuccguccccugcaccaucccccaggaguucgucacccacuucgucaacgagcaggcccccacccgcggcgaggccgcccuccuccacuacgucgaccccgacacccaccgcaaccucggcgaguucaagcucuaccccgagggcuucaugaccugcguccccaacuccuccggcuccggcccccagacccuccccaucaacggcgucuucaccuucaucuccugggucucccgcuucuaccagcucaagcccgucggcaccaccggccccguccgccgccucuga

SEQ ID NO: 17023 - RNA, 1617 nt, Artificial Sequence
  derived and/or modified sequence opt2 from VP1__Norovirus_and/or_Norovirus-like__L07418
augaugauggccuccaaggacgccccccaguccgccgacggcgccuccggcgccggccagcucguccccgaggucaacaccgccgacccccuccccauggagcccgucgccggccccaccaccgccgucgccaccgccggccaggucaacaugaucgaccccuggaucgucaacaacuucguccaguccccccagggcgaguucaccaucucccccaacaacacccccggcgacauccucuucgaccuccagcucggcccccaccucaaccccuuccucucccaccucucccagauguacaacggcugggucggcaacaugcgcguccgcauccuccucgccggcaacgccuucuccgccggcaagaucaucgucugcugcgucccccccggcuucaccuccuccucccucaccaucgcccaggccacccucuucccccacgucaucgccgacguccgcacccucgagcccaucgagaugccccucgaggacguccgcaacguccucuaccacaccaacgacaaccagcccaccaugcgccucgucugcaugcucuacaccccccuccgcaccggcggcggcuccggcaacuccgacuccuucgucgucgccggccgcguccucaccgcccccuccuccgacuucuccuuccucuuccucgucccccccaccaucgagcagaagacccgcgccuucaccguccccaacaucccccuccagacccucuccaacucccgcuuccccucccucauccagggcaugauccucucccccgacgccucccaggucguccaguuccagaacggccgcugccucaucgacggccagcuccucggcaccacccccgccaccuccggccagcucuuccgcguccgcggcaagaucaaccagggcgcccgcacccucaaccucaccgaggucgacggcaagcccuucauggccuucgacucccccgcccccgucggcuuccccgacuucggcaagugcgacuggcacaugcgcaucuccaagacccccaacaacaccggcuccggcgaccccaugcgcuccgucuccguccagaccaacguccagggcuucgucccccaccucggcuccauccaguucgacgaggucuucaaccaccccaccggcgacuacaucggcaccaucgaguggaucucccagcccuccaccccccccggcaccgacaucaaccucugggagauccccgacuacggcuccucccucucccaggccgccaaccucgccccccccgucuucccccccggcuucggcgaggcccucgucuacuucgucuccgccuuccccggccccaacaaccgcuccgcccccaacgacguccccugccuccucccccaggaguacaucacccacuucgucuccgagcaggcccccaccaugggcgacgccgcccuccuccacuacgucgaccccgacaccaaccgcaaccucggcgaguucaagcucuaccccggcggcuaccucaccugcguccccaacggcgucggcgccggcccccagcagcucccccucaacggcgucuuccucuucgucuccugggucucccgcuucuaccagcucaagcccgucggcaccgccuccaccgcccgcuga

SEQ ID NO: 17024 - RNA, 1617 nt, Artificial Sequence
  derived and/or modified sequence opt2 from VP1__Norovirus_and/or_Norovirus-like__FJ515294
augaugauggccuccaaggacgccccccaguccgccgacggcgccuccggcgccggccagcucguccccgaggucaacaccgccgacccccuccccauggagcccgucgccggccccaccaccgccgucgccaccgccggccaggucaacaugaucgaccccuggaucgucaacaacuucguccaguccccccagggcgaguucaccaucucccccaacaacacccccggcgacauccucuucgaccuccagcucggcccccaccucaaccccuuccucucccaccucucccagauguacaacggcugggucggcaacaugcgcguccgcauccuccucgccggcaacgccuucuccgccggcaagaucaucgucugcugcgucccccccggcuucaccuccuccucccucaccaucgcccaggccacccucuucccccacgucaucgccgacguccgcacccucgagcccaucgagaugccccucgaggacguccgcaacguccucuaccacaccaacgacaaccagcccaccaugcgccucgucugcaugcucuacaccccccuccgcaccggcggcggcuccggcaacuccgacuccuucgucgucgccggccgcguccucaccgcccccuccuccgacuucuccuuccucuuccucgucccccccaccaucgagcagaagacccgcgccuucaccguccccaacaucccccuccagacccucuccaacucccgcuuccccucccucauccagggcaugauccucucccccgacgccucccaggucguccaguuccagaacggccgcugccucaucgacggccagcuccucggcaccacccccgccaccuccggccagcucuuccgcguccgcggcaagaucaaccagggcgcccgcacccucaaccucaccgaggucgacggcaagcccuucauggccuucgacucccccgcccccgucggcuuccccgacuucggcaagugcgacuggcacaugcgcaucuccaagacccccaacaacaccuccuccggcgaccccaugcgcuccgucgacguccagaccgacguccagggcuucgucccccaccucggcuccauccaguucgacgaggucuucaaccaccccaccggcgacuacaucggcaccaucgaguggaucucccagcccuccaccccccccggcaccgacaucaaccucugggagauccccgacuacggcuccucccucucccaggccgccaaccucgccccccccgucuucccccccggcuucggcgaggcccucgucuacuucgucuccgccuuccccggccccaacaaccgcuccgcccccaacgacguccccugccuccucccccaggaguacgucacccacuucgucuccgagcaggcccccaccaugggcgacgccgcccuccuccacuacgucgaccccgacaccaaccgcaaccucggcgaguucaagcucuaccccggcggcuaccucaccugcguccccaacggcgucggcgccggcccccagcagcucccccucaacggcgucuuccucuucgucuccugggucucccgcuucuaccagcucaagcccgucggcaccgccuccaccgcccgcuga

SEQ ID NO: 17025 - RNA, 1617 nt, Artificial Sequence
  derived and/or modified sequence opt2 from VP1__Norovirus_and/or_Norovirus-like__KJ790198
augcgcauggccuccgacgacgccaaguccgcccccuccgaccucgagggcgccggccucguccccgccaccgccgccccccuccccgucgcccccgucgccggcgcccaggccgccgagcccuucgccggccagaucaacgucaucgaccccuggaucuacaccaacuucguccaggcccccaccggcgaguucaccgucuccccccgcaacacccccggcgagguccucgucaaccucgagaucggccccaaccucaaccccuaccuccagcaccucgcccagauguacaacggcuacgccggcggcgucgagguccaggucauccucgccggcaacgccuucaccgccggcaagcuccucugcgcccucgucccccccggcuuccccaccuccuccaucacccccgcccagcucaccaugcucccccacaccaucaucgacguccgcaccaccgaccccgucgucguccccaugcccgacguccgccgcacccucuggcacgagguccgcuccaccaccgagccccucaugcgccucgucaucaugcucuacacccccaugcgcgccaacuccggcuccgacgaggccuucgucgucuccggccgcguccucucccgccccgcccccgacuucaacuucuucuaccucguccccccccgcgucgaggacaccgucgagcccuucucccuccccgaccuccgcgucgacgagauguccuccucccgcuggcagaaccccgucgucaugcuccaggccgaccccaaccagaacaucgccgcccacuggcagaacggccgcugcaccaucaacggcgagcuccucggcaccaccccccgcaaccaguccuggcuccuccgcaugcgcggcuccguccucgccgcccccggcggccagaaggccgucaccgucaacgucgaccucaccgagcccgacggccaggccuucuccguccucuccggcaaccccggccccgagggcguccccgacuuccaggccaucuacaacguccgcauguccaccgccuccaccaccgccggccacaccgucgccaccaacggcuacaucgagcaguccggcuacacccccgcccucggcacccucgucauccagggcgucgaccucucccagguccccgcccucggcuccgaggucaccaugcaggucgucuccaucgaccucaaccacaacauggaccccacccgccuccccgacuacaacggcgccggcuucgacggcuccgucgcccucgcccccccccucguccccccccuccccggcgagguccuccuccgcuucaccacccuccccaucaccaccucccgcggcuccuccgucuccgccacccucgacugcgcccuccccgccgaguggaucaccugguuccucguccacaacuucgucccccagggcgacgccgcccuccuccgcuaccgcaaccgcggcaccggccagauccucuucgagugcaagcucuacaaggagggcuuccucgccgucgccggcgucuccacccgcaccgucuuccccaccuccggcgucuucgaguucgucuccuggguccccgucuucuaccagcucacccccgucggcuccuccggcgcccgcaagcgcuga

SEQ ID NO: 17026 - RNA, 1617 nt, Artificial Sequence
  derived and/or modified sequence opt2 from VP1__Norovirus_and/or_Norovirus-like__KF306212
augaugauggccuccaaggacgccccccaguccgccgacggcgccuccggcgccggccagcucguccccgaggucaacaccgccgacccccuccccauggagcccgucgccggccccaccaccgccgucgccaccgccggccaggucaacaugaucgaccccuggaucgucaacaacuucguccaguccccccagggcgaguucaccaucucccccaacaacacccccggcgacauccucuucgaccuccagcucggcccccaccucaaccccuuccucucccaccucucccagauguacaacggcugggucggcaacaugcgcguccgcauccuccucgccggcaacgccuucuccgccggcaagaucaucgucugcuucgucccccccggcuucaccuccuccucccucaccaucgcccaggccacccucuucccccacgucaucgccgacguccgcacccucgagcccaucgagaugccccucgaggacguccgcaacguccucuaccacaccaacgacaaccagcccaccaugcgccucgucugcaugcucuacaccccccuccgcaccggcggcggcuccggcuccuccgacuccuucgucgucgccggccgcguccucaccgcccccuccuccgacuucuccuuccucuuccucgucccccccaccaucgagcagaagacccgcgccuucaccguccccaacaucccccuccagacccucuccaacucccgcuuccccucccucauccagggcaugauccucucccccgacgccucccaggucguccaguuccagaacggccgcugccucaucgacggccagcuccucggcaccacccccgccaccuccggccagcucuuccgcguccgcggcaagaucaaccagggcgcccgcacccucaaccucaccgaggucgacggcaagcccuucauggccuucgacucccccgcccccgucggcuuccccgacuucggcaagugcgacuggcacaugcgcaucuccaagacccccaacaacaccuccuccggcgaccccaugcgcuccgucuccguccagaccaacguccagggcuucgucccccaccucggcuccauccaguucgacgaggucuucaaccaccccaccggcgacuacaucggcaccaucgaguggaucucccagcccuccaccccccccggcaccgacaucaaccucugggagauccccgacuacggcuccucccucucccaggccgccaaccucgccccccccgucuucccccccggcuucggcgaggcccucgucuacuucgucuccgccuuccccggccccaacaaccgcuccgcccccaacgacguccccugccuccucccccaggaguacaucacccacuucgucuccgagcaggcccccaccaugggcgacgccgcccuccuccacuacgucgaccccgacaccaaccgcaaccucggcgaguucaagcucuaccccggcggcuaccucaccugcguccccaacggcgucggcgccggcccccagcagcucccccucaacggcgucuuccucuucgucuccugggucucccgcuucuaccagcucaagcccgucggcaccgccuccaccgcccgcuga

SEQ ID NO: 17027 - RNA, 1617 nt, Artificial Sequence
  derived and/or modified sequence opt2 from VP1__Norovirus_and/or_Norovirus-like__KM461694
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaacgcccgcgccgccgaccucaccgacuccccccagcgcgcccgcaaccacccccuccacguccaggucaagaaccucgacggcacccaguacgaccccaccgacgacauccccgccguccucggcgccaucgacuucaagggcaccgucuucggcgucgccucccagcgcgacgucuccggcacccaggagcagggccacuacgccacccgcgcccacgaggcccacaucgacaccaccgaccccaaguacgcccccaagcucggcaccauccucaucaaguccgaguccaccgacuucaccaccaaccagcccauccgcuucacccccgucggcaugggcgacaacaacuggcgccagugggagcuccccgacuacuccggcucccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgccuga

SEQ ID NO: 17028 - RNA, 1614 nt, Artificial Sequence
  derived and/or modified sequence opt2 from VP1__Norovirus_and/or_Norovirus-like__AB039780
augaagauggccuccaacgacgccgcccccuccaacgacggcgccgccggccucguccccgagaucaaccacgaggucauggccaucgagcccgucgccggcgccucccucgccgcccccgucgucggccagcucaacaucaucgaccccuggauccgcaacaacuucguccaggcccccgccggcgaguucaccgucuccccccgcaacgcccccggcgaguuccuccucgaccucgagcucggccccgagcucaaccccuaccucgcccaccucgcccgcauguacaacggccacgccggcggcauggagguccagaucguccucgccggcaacgccuucaccgccggcaagauccucuucgccgucaucccccccggcuuccccuacgagaaccucucccccgcccagcucaccaugugcccccacgucgucgucgacguccgccagcucgagcccauccuccuccccaugcccgacauccgcaacaccuucuuccacuacaaccaguccaacggccccaagcuccgccucgucgccaugcucuacaccccccuccgcgccaacaacgccggcgaggacgucuucaccgucuccugccgcguccucacccgccccucccccgacuucgaguucaacuuccucgucccccccuccgucgaguccaagaccaaggccuucacccuccccauccucaagaucuccgagaugaccaacucccgcuuccccauccccgucgaccagauguacaccucccgcaacgagaacaucgucguccagccccagaacggccgcgucacccucgacggcgagcuccagggcaccaccacccuccagcccgucuccaucugcggcuuccgcggcacccuccagacccgccucgccgaccagcccaacuacaccuaccagguccaccucgagaaccucgacggcucccccgucgaccccaccgacgagguccccgccccccucggcacccccgacuuccaggcccagcucuucggcgucaucucccagcgcuccuccgacaacgccacccgcgcccacgaggcccgcgucaacaccaacgaccccaccuucgccccccagaucgcccagguccgcuucaagucccccuccaacgacuucuucgacaacgagcccaucaaguucacccccgucggcaucuccgucgacucccagaacuccuacaaccaguggcuccucccccgcuacggcggccaccucaccaacaacacccaccucgcccccuccgucucccccauguuccccggcgagcagauccucuucuuccgcuccuucaugcccggcgccuccggccacaccgacggcgccaucgacugccuccucccccaggagugggucgcccacuucuaccaggaggccgccaccgcccagaccgacgucgcccucauccgcuucgucaaccccgacaccggccgcguccucuucgagggcaagcuccacaagcagggcuucaucaccaucuccaacuccggcgaccaccccaucgucaugcccgccaacggcuacuuccgcuucgaggccugggucaaccaguucuacucccucgcccccgucggcaccggcuccggccgccgccgcauccaguga

SEQ ID NO: 17029 - RNA, 1614 nt, Artificial Sequence
  derived and/or modified sequence opt2 from VP1__Norovirus_and/or_Norovirus-like__AY038599
augaagauggccuccaacgacgccgcccccuccuccgacggcgccgccggcgucguccccgagaucaaccacgaggucauggccaucgagcccgucgccggcgccuccaucgccgcccccgucgucggccagcagaacaucaucgaccccuggauccgcaacaacuucguccaggcccccgccggcgaguucaccgucuccccccgcaacgcccccggcgaguuccuccucgaccucgagcucggccccgaccucaaccccuaccucgcccaccucgcccgcauguacaacggccacgccggcggcauggagguccagaucguccucgccggcaacgccuucaccgccggcaagauccucuucgccgucaucccccccggcuuccccuacgagaaccucugccccgcccagcucaccaugugcccccacgucgucgucgacguccgccagcucgagcccgucaugcuccccaugcccgacauccgcaacaccuucuuccacuacaaccaggacggcggccccaagcuccgccucaucgccaugcucuacaccccccuccgcgccaacaacuccggcgacgacgucuucaccgucuccugccgcguccucacccgccccgcccccgacuucgaguucaccuuccucgucccccccuccaucgaguccaagaccaaggccuucaccauccccguccucaagaucuccgagaugaccaacucccgcuuccccguccccgucgaccagauguacaccucccgcuccgagggcaucgucguccagccccagaacggccgcgccaccaucgacggcgagcuccucggcaccacccucgucucccccgucuccgucugcaacuucaagggcaaccuccaggccgagguccccggccagcaccagcucuaccagcuccagcucaccaaccucgacggcucccccaucgaccccaccgacgacacccccggcccccucggcugccccgacuucaccggccuccucuacggcgucgccucccagcgcggccccggcgacgccacccgcgcccacgaggcccgcaucgacaccggcuccgacaccuucgcccccaagaucggccagguccgcuucuacuccaccuccuccgacuucgagaccaaccagcccacccacuucacccccaucggcaucuacaucgagggcaacuccuccgacuucaaccaguggcagcucccccgcuacggcggccaccucgccaacaacaaccaccucgcccccgccgucuccccccucuuccccggcgagcagauccucuucuuccgcuccuucauccccggcgccuccggccacaccaacggcgagauggacugccuccucccccaggaguucguccagcacuucuaccaggaggccgccaccgcccgcuccgaggucgcccuccuccgcuucgucaaccccgacaccggccgcgcccucuucgaguccaagcuccacaagcagggcuucaugaccaucgccuccuccggcgaccaccccaucaucaugcccaccaacggcuacuuccgcuucgaggccugggucaaccaguucuacucccucgcccccgucggcaccggcuccggccgccgccgcauccaguga

SEQ ID NO: 17030 - RNA, 1614 nt, Artificial Sequence
  derived and/or modified sequence opt2 from VP1__Norovirus_and/or_Norovirus-like__AY054299
augaagauggccuccaacgacgccgcccccuccuccgacggcgccgccggccucguccccgagaucaaccacgaggucauggccaucgagcccgucgccggcgccuccaucgccgcccccgucgucggccagcagaacaucaucgaccccuggauccgcaacaacuucguccaggcccccgccggcgaguucaccgucuccccccgcaacgcccccggcgaguuccuccucgaccucgagcucggccccgaccucaaccccuaccucgcccaccucgcccgcauguacaacggccacgccggcggcauggagguccagaucguccucgccggcaacgccuucaccgccggcaagauccucuucgccgucaucccccccggcuuccccuacgagaaccucucccccgcccagcucaccaugugcccccacgucgucgucgacguccgccagcucgagcccgucaugcuccccaugcccgacauccgcaacaccuucuuccacuacaaccaggacggcggcccccgccuccgccucaucgccaugcucuacaccccccuccgcgccaacaacuccggcgacgacgucuucaccgucuccugccgcguccucacccgccccgcccccgacuucgaguucaccuuccucgucccccccuccaucgaguccaagaccaaggccuucaccauccccguccucaagaucuccgagaugaccaacucccgcuuccccguccccgucgaccagauguacaccucccgcuccgagggcaucgucguccagccccagaacggccgcgccaccaucgacggcgagcuccucggcaccacccucgucucccccgucuccgucugcaacuucaagggcaaccuccaggccgagguccccggcgagcaccagcucuaccagcuccagcucaccaaccucgacggcucccccaucgaccccaccgacgacacccccggcccccucggcugccccgacuucaccggccuccucuacggcgucgccucccagcgcggccccggcgacgccacccgcgcccacgaggcccgcaucgacaccggcuccgacaccuacgcccccaagaucggccagguccgcuucuacuccaccuccuccaacuucgagcgcaaccagcccacccacuucacccccaucggcaucuacaucgagggcaacuccuccgacuucaaccaguggcagcucccccgcuacggcggccaccucgccaacaacaaccaccucgcccccgccgucuccccccucuuccccggcgagcagauccucuucuuccgcuccuucauccccggcgccuccggccacaccaacggcgagauggacugccuccucccccaggaguucguccagcacuucuaccaggaggccgccaccgcccaguccgaggucgcccuccuccgcuucgucaaccccgacaccggccgcguccucuucgaguccaagcuccacaagcagggcuucaugaccaucgccuccuccggcgaccaccccaucaucaugcccaccaacggcuacuuccgcuucgaggccugggucaaccaguucuacucccucgcccccgucggcaccggcuccggccgccgccgcauccaguga

SEQ ID NO: 17031 - RNA, 1614 nt, Artificial Sequence
  derived and/or modified sequence opt2 from VP1__Norovirus_and/or_Norovirus-like__AF195848
augaagauggccuccaacgacgccgcccccuccaacgacggcgccgccggccucguccccgagaucaaccacgaggucauggccaucgagcccgucgccggcgccucccucgccgcccccgucgucggccagcucaacaucaucgaccccuggauccgcaacaacuucguccaggcccccgccggcgaguucaccgucuccccccgcaacgcccccggcgaguuccuccucgaccucgagcucggccccgagcucaaccccuaccucgcccaccucgcccgcauguacaacggccacgccggcggcauggagguccagaucguccucgccggcaacgccuucaccgccggcaagauccucuucgccgucaucccccccggcuuccccuacgagaaccucucccccgcccagcucaccaugugcccccacgucgucgucgacguccgccagcucgagcccauccuccuccccaugcccgacauccgcaacaccuucuuccacuacaaccaguccaacggccccaagcgccgccucgucgccaugcucuacaccccccuccgcgccaacaacgccggcgacgacgucuucaccgucuccugccgcguccucacccgccccucccccgacuucgaguucaacuuccucgucccccccuccgucgaguccaagaccaaggccuucacccuccccguccucaagaucuccgagaugaccaacucccgcuuccccauccccgucgaccagauguacaccucccgcaacgagaacaucgucguccagccccagaacggccgcgucacccucgacggcgagcuccagggcaccaccacccuccagcccgucuccaucugcggcuuccgcggcacccuccagacccgccucgccgaccagcccaacuacaccuaccagguccaccucgagaaccucgacggcucccccgucgaccccaccgacgagguccccgccccccucggcacccccgacuuccaggcccagcucuucggcgucaucucccagcgcuccuccgacaacgccacccgcgcccacgaggcccgcgucaacaccaacgaccccaccuucgccccccagaucgcccagguccgcuucaagucccccuccaccgacuucuccgacaacgagcccaucaaguucacccccgucggcaucuccgucgacucccagaacuccuacaaccaguggcuccucccccgcuacggcggccaccucaccaacaacacccaccucgcccccuccgucucccccauguuccccggcgagcagauccucuucuuccgcuccuucaugcccggcgccggcggcuucaccgacggcgccaucgacugccuccucccccaggagugggucgcccacuucuaccaggaggccgccaccgcccagaccgacgucgcccucauccgcuucgucaaccccgacaccggccgcguccucuucgagggcaagcuccacaagcagggcuucaucaccaucuccaacuccggcgaccaccccaucgucaugcccgccaacggcuacuuccgcuucgaggccugggucaagcaguucuacucccucgcccccgucggcaccggcuccggccgccgccgcguccaguga

SEQ ID NO: 17032 - RNA, 1614 nt, Artificial Sequence
  derived and/or modified sequence opt2 from VP1__Norovirus_and/or_Norovirus-like__AB303927
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccgucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcuccaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17033 - RNA, 1614 nt, Artificial Sequence
  derived and/or modified sequence opt2 from VP1__Norovirus_and/or_Norovirus-like__AY038600
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaucaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgaccuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17034 - RNA, 1614 nt, Artificial Sequence
  derived and/or modified sequence opt2 from VP1__Norovirus_and/or_Norovirus-like__AF080554
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccaccaaggaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17035 - RNA, 1614 nt, Artificial Sequence
  derived and/or modified sequence opt2 from VP1__Norovirus_and/or_Norovirus-like__AB294778
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccgucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcuccaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17036 - RNA, 1614 nt, Artificial Sequence
  derived and/or modified sequence opt2 from VP1__Norovirus_and/or_Norovirus-like__AB303922
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcggcgacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcgacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17037 - RNA, 1614 nt, Artificial Sequence
  derived and/or modified sequence opt2 from VP1__Norovirus_and/or_Norovirus-like__AY532128
augaagauggccuccaacgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcauccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17038 - RNA, 1614 nt, Artificial Sequence
  derived and/or modified sequence opt2 from VP1__Norovirus_and/or_Norovirus-like__AY532113
augaagauggccuccaacgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccaccaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17039 - RNA, 1614 nt, Artificial Sequence
  derived and/or modified sequence opt2 from VP1__Norovirus_and/or_Norovirus-like__EU078406
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacgucaucgucgacguccgccagcucgagcccguccucaucccccuccccgacguccgcaacaacuucuaccacuacaaccaggcccacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgacuucgucguccagccccagaacggccgcugcaccaccgacggcguccuccucggcaccacccagcucuccgccgucaacaucugcaacuucaagggcgacgucacccacaucgccggcucccgcgacuaccgcaugaaccucgucucccagaacuggaacaacuacgaccccaccgaggagauccccgccccccucggcacccccgacuuccagggcaagauccagggccuccucacccagaccaccggcgccgacggcuccacccgcgcccacaaggccaccgucuccaccggcgccgccaacuucacccccaagcucggcuccguccaguucaccaccgacaccgacaacgacuuccagaccggccagaacaccaaguucacccccgucggcgucauccaggacggcucccaccaccagaacgagccccagcaguggguccuccccaacuacuccggccgcaccguccacaacguccaccucgcccccgccgucgcccccaccuuccccggcgagcagcuccucuucuuccgcuccaccaugcccggcugcuccggcuaccccaacaugaaccucgacugccuccucccccaggagugggucaugcacuucuaccaggaggccgcccccgcccaguccgacgucgcccuccuccgcuucgucaaccccgacaccggccgcguccucuucgagugcaagcuccacaaggccggcuacaucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 17040 - RNA, 1614 nt, Artificial Sequence
  derived and/or modified sequence opt2 from VP1__Norovirus_and/or_Norovirus-like__AF472623
augaagauggccuccaacgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17041 - RNA, 1614 nt, Artificial Sequence
  derived and/or modified sequence opt2 from VP1__Norovirus_and/or_Norovirus-like__AF427114
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgccuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcuccaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17042 - RNA, 1614 nt, Artificial Sequence
  derived and/or modified sequence opt2 from VP1__Norovirus_and/or_Norovirus-like__AY532114
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccaccaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17043 - RNA, 1614 nt, Artificial Sequence
  derived and/or modified sequence opt2 from VP1__Norovirus_and/or_Norovirus-like__KF806505
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacuggaacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17044 - RNA, 1614 nt, Artificial Sequence
  derived and/or modified sequence opt2 from VP1__Norovirus_and/or_Norovirus-like__JQ478407
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacaucacccacaucgccggcucccacgacuacaccaugaaccucgccucccagaacugguccaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcggcaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17045 - RNA, 1614 nt, Artificial Sequence
  derived and/or modified sequence opt2 from VP1__Norovirus_and/or_Norovirus-like__AB303923
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17046 - RNA, 1614 nt, Artificial Sequence
  derived and/or modified sequence opt2 from VP1__Norovirus_and/or_Norovirus-like__AF427120
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucaucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17047 - RNA, 1614 nt, Artificial Sequence
  derived and/or modified sequence opt2 from VP1__Norovirus_and/or_Norovirus-like__AY532134
augaagauggccuccaacgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaucaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcgccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacgcccucgcccccaugggcaacggcgccggccgccgccgcuga

SEQ ID NO: 17048 - RNA, 1614 nt, Artificial Sequence
  derived and/or modified sequence opt2 from VP1__Norovirus_and/or_Norovirus-like__AY532116
augaagauggccuccaacgacgccaaccccuccgacggcuccaccgccaaccucguccccgaggucaacaacgaggucauggcccucgagcccgucgucggcgccgccaucgccacccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17049 - RNA, 1614 nt, Artificial Sequence
  derived and/or modified sequence opt2 from VP1__Norovirus_and/or_Norovirus-like__AY532112
augaagauggccuccaacgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccgcccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17050 - RNA, 1614 nt, Artificial Sequence
  derived and/or modified sequence opt2 from VP1__Norovirus_and/or_Norovirus-like__KX514275
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcuccgccgacuucacccccaagcucggcaagguccaguucgagaccgacaccgaggacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17051 - RNA, 1614 nt, Artificial Sequence
  derived and/or modified sequence opt2 from VP1__Norovirus_and/or_Norovirus-like__KF806510
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacuggaacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcaacauccgcuucuccaccgacaccaacaacgacuucgaggccggccagaacaccaaguucacccccgucggcgucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17052 - RNA, 1614 nt, Artificial Sequence
  derived and/or modified sequence opt2 from VP1__Norovirus_and/or_Norovirus-like__EU078410
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaccauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccaggccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 17053 - RNA, 1614 nt, Artificial Sequence
  derived and/or modified sequence opt2 from VP1__Norovirus_and/or_Norovirus-like__AF427123
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacaacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17054 - RNA, 1614 nt, Artificial Sequence
  derived and/or modified sequence opt2 from VP1__Norovirus_and/or_Norovirus-like__AY532135
augaagauggccuccaacgacgccaacccccccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17055 - RNA, 1614 nt, Artificial Sequence
  derived and/or modified sequence opt2 from VP1__Norovirus_and/or_Norovirus-like__AY532125
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17056 - RNA, 1614 nt, Artificial Sequence
  derived and/or modified sequence opt2 from VP1__Norovirus_and/or_Norovirus-like__AJ277619
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggccucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacgacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucucccagaccacccgcggcgacgacuccacccgcgcccacaaggccaccgucuccaccggcuccguccacuucacccccaagcucggcuccguccaguacaccaccgacaccaacaacgacuucgagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccagcucuacacccucgcccccaugggcaacggcgccggccgccgccgcuga

SEQ ID NO: 17057 - RNA, 1614 nt, Artificial Sequence
  derived and/or modified sequence opt2 from VP1__Norovirus_and/or_Norovirus-like__AF080556
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccaggccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17058 - RNA, 1614 nt, Artificial Sequence
  derived and/or modified sequence opt2 from VP1__Norovirus_and/or_Norovirus-like__AF080550
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17059 - RNA, 1614 nt, Artificial Sequence
  derived and/or modified sequence opt2 from VP1__Norovirus_and/or_Norovirus-like__EU078407
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcggcgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 17060 - RNA, 1614 nt, Artificial Sequence
  derived and/or modified sequence opt2 from VP1__Norovirus_and/or_Norovirus-like__AB083781
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcacccuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucucccagaccacccgcggcgacggcuccacccgcgcccacaaggccaccgucuccaccggcuccguccacuucacccccaagcucggcuccguccaguacaccaccgacaccaacaacgacuucgagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17061 - RNA, 1614 nt, Artificial Sequence
  derived and/or modified sequence opt2 from VP1__Norovirus_and/or_Norovirus-like__AF427122
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccgccucuccgccgucaacaucugcaccuuccgcggcgacgucacccacaucgccggcucccgcgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgucggccgccgccgcuga

SEQ ID NO: 17062 - RNA, 1614 nt, Artificial Sequence
  derived and/or modified sequence opt2 from VP1__Norovirus_and/or_Norovirus-like__AY532133
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucucccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaucaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17063 - RNA, 1614 nt, Artificial Sequence
  derived and/or modified sequence opt2 from VP1__Norovirus_and/or_Norovirus-like__AY532131
augaagauggccuccaacgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcgucuacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17064 - RNA, 1614 nt, Artificial Sequence
  derived and/or modified sequence opt2 from VP1__Norovirus_and/or_Norovirus-like__AY532121
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcacccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccuggaucaaccaguucuacacccucgcccccaugggcaacggcgccggccgccgccgcuga

SEQ ID NO: 17065 - RNA, 1614 nt, Artificial Sequence
  derived and/or modified sequence opt2 from VP1__Norovirus_and/or_Norovirus-like__AY532115
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgacguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17066 - RNA, 1614 nt, Artificial Sequence
  derived and/or modified sequence opt2 from VP1__Norovirus_and/or_Norovirus-like__KF806530
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucgccggcacccacgaguacgccaugaaccucgccucccagaacuggaacaacuacgaccccaccgaggagauccccgccccccucggcgcccccgacuucgucggcaagauccgcggcguccucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17067 - RNA, 1614 nt, Artificial Sequence
  derived and/or modified sequence opt2 from VP1__Norovirus_and/or_Norovirus-like__KF806513
augaagauggccuccaacgacgccucccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacuggaacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcuccauccgcuucuccaccgacaccaacaacgacuucgaggccucccagaacaccaaguucacccccgucggcgucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17068 - RNA, 1614 nt, Artificial Sequence
  derived and/or modified sequence opt2 from VP1__Norovirus_and/or_Norovirus-like__AY741811
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccucaaggccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17069 - RNA, 1614 nt, Artificial Sequence
  derived and/or modified sequence opt2 from VP1__Norovirus_and/or_Norovirus-like__AY532122
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuucggcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcgacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17070 - RNA, 1614 nt, Artificial Sequence
  derived and/or modified sequence opt2 from VP1__Norovirus_and/or_Norovirus-like__AY532120
augaagauggccuccaacgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacuccuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacuccgacuuccagaccggccagaacaccaaguucacccccgucggcgucauccaggacggcaacaaccaccagaacgagccccagcaguggguccuccccaacuacuccggcggcaccggccacaacguccaccucgcccccgccgucgcccccaccuuccccggcgagcagcuccucuucuuccgcuccaccaugcccggcugcuccggcuaccccaacaugaaccucgacugcuacuccccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17071 - RNA, 1614 nt, Artificial Sequence
  derived and/or modified sequence opt2 from VP1__Norovirus_and/or_Norovirus-like__AY532111
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucucccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaggucuacacccucgcccccaugggcaacggcgccggccgccgccgcuga

SEQ ID NO: 17072 - RNA, 1614 nt, Artificial Sequence
  derived and/or modified sequence opt2 from VP1__Norovirus_and/or_Norovirus-like__AF080558
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcggcgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucacccaggacggcgacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17073 - RNA, 1614 nt, Artificial Sequence
  derived and/or modified sequence opt2 from VP1__Norovirus_and/or_Norovirus-like__KF806508
augaagauggccuccaacgacgccucccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacuggaacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcaucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17074 - RNA, 1614 nt, Artificial Sequence
  derived and/or modified sequence opt2 from VP1__Norovirus_and/or_Norovirus-like__AF425766
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucauccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgaccucgucggcaagauccagggcaugcucacccagaccacccgcgaggacggcuccacccgcgcccacaaggccaccgucuccaccggcuccguccacuucacccccaagcucggcuccguccaguacaccaccgacaccuccaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17075 - RNA, 1614 nt, Artificial Sequence
  derived and/or modified sequence opt2 from VP1__Norovirus_and/or_Norovirus-like__AJ583672
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaccaucuucgccgccgucccccccaacuuccccaccgagggccucucccccucccaggucaccauguucccccacaucaucgucgacguccgccagcccgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccaacgccuucgucguccagccccagaacggccgcugcaccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucucccagaccacccgcggcgacggcuccacccgcggccacaaggccaccgucuccaccggcuccguccacuucacccccaagcucggcuccguccaguacaccaccgacaccaacaacgaccucgaggccggccaguccaccaaguucacccccgucggcgucguccaggacggcaacaaccaccagaacgagccccagcaguggguccuccccaacuacuccggccgcaccggccacaacguccaccucguccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 17076 - RNA, 1614 nt, Artificial Sequence
  derived and/or modified sequence opt2 from VP1__Norovirus_and/or_Norovirus-like__AY532119
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacuccgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17077 - RNA, 1614 nt, Artificial Sequence
  derived and/or modified sequence opt2 from VP1__Norovirus_and/or_Norovirus-like__AF080552
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccuccggcuacuuccgcuucgacuccugggucaaccaguucuacacccucgcccccaugggcaacggcgccggccgccgccgcuga

SEQ ID NO: 17078 - RNA, 1614 nt, Artificial Sequence
  derived and/or modified sequence opt2 from VP1__Norovirus_and/or_Norovirus-like__KX514177
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcaccacccagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcuccgccaacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17079 - RNA, 1614 nt, Artificial Sequence
  derived and/or modified sequence opt2 from VP1__Norovirus_and/or_Norovirus-like__KF806514
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacugggacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcaacauccgcuucuccaccgacaccaacaacgacuucgaggccggccagaacaccaaguucacccccgucggcgucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17080 - RNA, 1614 nt, Artificial Sequence
  derived and/or modified sequence opt2 from VP1__Norovirus_and/or_Norovirus-like__AB303925
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccuggaucaaccaguucuacacccucgcccccaugggcaacggcgccggccgccgccgcuga

SEQ ID NO: 17081 - RNA, 1614 nt, Artificial Sequence
  derived and/or modified sequence opt2 from VP1__Norovirus_and/or_Norovirus-like__KF806534
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgaccucacccacuucgccggcaccuccgaguacgccaugaaccucgccucccagaacuggaccaacuacgaccccaccgaggagauccccgccccccucggcgcccccgacuucgucggcaagauccgcggcguccucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17082 - RNA, 1614 nt, Artificial Sequence
  derived and/or modified sequence opt2 from VP1__Norovirus_and/or_Norovirus-like__KF806519
augaagauggccuccaacgacgccucccccuccgacggcuccgccgccaaccucguccccgaggucaacaacgaggucauggcccucgagcccgucgucggcgccaccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucucccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacuggaacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcaacauccgcuucuccaccgacaccaacaacgacuucgaggccggccagaacaccaaguucacccccgucggcgucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17083 - RNA, 1614 nt, Artificial Sequence
  derived and/or modified sequence opt2 from VP1__Norovirus_and/or_Norovirus-like__AB303924
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuucugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17084 - RNA, 1614 nt, Artificial Sequence
  derived and/or modified sequence opt2 from VP1__Norovirus_and/or_Norovirus-like__DQ975270
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcaccuacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17085 - RNA, 1614 nt, Artificial Sequence
  derived and/or modified sequence opt2 from VP1__Norovirus_and/or_Norovirus-like__AF414424
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacgucggccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaccccccccaacggcuacuuccgcuucgacuccugggucaaccaguucuacacccucgcccccaugggcaacggcgccggccgccgccgcuga

SEQ ID NO: 17086 - RNA, 1614 nt, Artificial Sequence
  derived and/or modified sequence opt2 from VP1__Norovirus_and/or_Norovirus-like__LC048964
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagaaccagggccuccucucccagaccacccgcggcgacggcuccacccgcgcccacaaggccaccgucuccaccggcuccguccacuucacccccaagcucggcuccguccaguacaccaccgacaccaacaacgacuucgagaccggccagaacaccaaguucacccccgucggcgucauccaggacggcaacaaccaccagaacgagccccagcagugggcccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17087 - RNA, 1614 nt, Artificial Sequence
  derived and/or modified sequence opt2 from VP1__Norovirus_and/or_Norovirus-like__AB684705
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucucccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagacccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccgcgucggcaucucccacgacuacaccaugaaccucgucucccagaacuggaacaacuacgaccccaccgaggagauccccgccccccucggcacccccgacuucgucggcaagauccagggccuccucacccagaccacccgcgccgacuccuccacccgcgcccacaaggccacccucuccaccggcuccguccacuucacccccaagcucggcuccguccaguucaccaccgacaccaacaacgacuuccagaccggccagaacaccaaguucacccccgucggcgucauccaggacuccgaccaccaccagaacgagccccagcaguggguccuccccaacuacuccggcuccuccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17088 - RNA, 1614 nt, Artificial Sequence
  derived and/or modified sequence opt2 from VP1__Norovirus_and/or_Norovirus-like__KF806523
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucucccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacuggaacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcaacauccgcuucuccaccgacaccaacaacgacuucgaggccggccagaacaccaaguucacccccgucggcgucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17089 - RNA, 1614 nt, Artificial Sequence
  derived and/or modified sequence opt2 from VP1__Norovirus_and/or_Norovirus-like__AY532129
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccacggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacuccuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17090 - RNA, 1614 nt, Artificial Sequence
  derived and/or modified sequence opt2 from VP1__Norovirus_and/or_Norovirus-like__AY532124
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgcccgcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17091 - RNA, 1614 nt, Artificial Sequence
  derived and/or modified sequence opt2 from VP1__Norovirus_and/or_Norovirus-like__KX514309
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccaccccggcggcuccaagaucuacaccaugaaccucgccucccccaacuggaacaacuacgaccccaccgaggagauccccgccccccucggcacccccgacuucgucggcaagauccacggcaugcucacccagaccaccaagggcgagggcuccacccgcggccaccgcgccaccgucuacgucggcggcgccaacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17092 - RNA, 1614 nt, Artificial Sequence
  derived and/or modified sequence opt2 from VP1__Norovirus_and/or_Norovirus-like__KX514308
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgacaagcucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccgccacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcuccgccgacuucacccccaagcucggcaagguccaguucgagaccgacaccgaggacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17093 - RNA, 1614 nt, Artificial Sequence
  derived and/or modified sequence opt2 from VP1__Norovirus_and/or_Norovirus-like__KX514283
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgucacccucgacaagcucuucaccggccccuccuccaccaucgucguccagccccagaacggccgcugcaugaucgacggcguccuccucggcaccacccagcucucccccgucaacaucugcaccuuccgcggcgacgucacccacccccgcgacuccaccaucuacaccaugaaccucgccucccccaacuggaacaacuacgaccccaccgaggagauccccgccccccucggcacccccgacuucaccggcaagauccagggcaugcucacccagaccaccaagggcgagggcuccacccgcggccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17094 - RNA, 1614 nt, Artificial Sequence
  derived and/or modified sequence opt2 from VP1__Norovirus_and/or_Norovirus-like__KX514194
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcaacggcuccacccgcggccaccgcgccaccgucuacgucggcuccgccgaguucacccccaagcucggcaagguccaguucaagaccgagaccgaccacgaccucgccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17095 - RNA, 1614 nt, Artificial Sequence
  derived and/or modified sequence opt2 from VP1__Norovirus_and/or_Norovirus-like__KY424340
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagucccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgacuacaccaugaaccucgccucccagaacugguccaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17096 - RNA, 1614 nt, Artificial Sequence
  derived and/or modified sequence opt2 from VP1__Norovirus_and/or_Norovirus-like__LC016606
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcacccacaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccaacaacgacuucgagaccggccagaacacccgcuucacccccgucggcgucauccaggacggcuccgcccaccgcaacgagccccagcaguggguccuccccgacuacuccggcaagaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 17097 - RNA, 1614 nt, Artificial Sequence
  derived and/or modified sequence opt2 from VP1__Norovirus_and/or_Norovirus-like__FJ537136
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagucccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgacuacaccaugaaccucgucucccagaacugguccaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17098 - RNA, 1614 nt, Artificial Sequence
  derived and/or modified sequence opt2 from VP1__Norovirus_and/or_Norovirus-like__AY532117
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccucggccccuggggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccuccaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccccuacgaccucgucaucccccccaacggcuacuuccgcuucgacuccugggucaaccaguucuacacccucgcccccaugggcaacggcgccggccgccgccgcuga

SEQ ID NO: 17099 - RNA, 1614 nt, Artificial Sequence
  derived and/or modified sequence opt2 from VP1__Norovirus_and/or_Norovirus-like__KX514279
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccacccaccacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcuccgccgacuucacccccaagcucggcaagguccaguucgagaccgacaccgaggacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17100 - RNA, 1614 nt, Artificial Sequence
  derived and/or modified sequence opt2 from VP1__Norovirus_and/or_Norovirus-like__LC016602
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcaccuccaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgacaccgacaccaacaacgaccucgagaccggccagaacacccgcuucacccccgucggcgucauccaggacggcuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 17101 - RNA, 1614 nt, Artificial Sequence
  derived and/or modified sequence opt2 from VP1__Norovirus_and/or_Norovirus-like__AF145896
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagucccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgacuacaccaugaaccucgccucccagaacugguccaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuucgaccucgucaucccccccaacggcuacuuccgcuucgacuccugggucaaccaguucuacacccucgcccccaugggcaacggcaccggccgccgccgcuga

SEQ ID NO: 17102 - RNA, 1614 nt, Artificial Sequence
  derived and/or modified sequence opt2 from VP1__Norovirus_and/or_Norovirus-like__AB684704
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucucccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacuccaaguuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccgcgucggcaccucccacgacuacaccaugaaccucgucucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuucgagaccggccagaacaccaaguucacccccgucggcgucauccaggacggcgaccaccaccagaacgagccccagcaguggguccuccccuccuacuccggcuccuccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17103 - RNA, 1614 nt, Artificial Sequence
  derived and/or modified sequence opt2 from VP1__Norovirus_and/or_Norovirus-like__JX401279
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccgcgucggcaccucccacgacuacaccaugaaccucgucucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccgacaacgacuuccagaccggccagaacaccaaguucacccccgucggcgucauccaggacggcgaccaccaccagaacgagccccagcaguggguccuccccaacuacuccggcaccuccggccacaacguccaccucgcccccgccgucgcccccgccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17104 - RNA, 1614 nt, Artificial Sequence
  derived and/or modified sequence opt2 from VP1__Norovirus_and/or_Norovirus-like__GQ389627
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacugguccaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucugccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17105 - RNA, 1614 nt, Artificial Sequence
  derived and/or modified sequence opt2 from VP1__Norovirus_and/or_Norovirus-like__AF425763
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggccccccgcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcccuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucaccccccgccucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17106 - RNA, 1614 nt, Artificial Sequence
  derived and/or modified sequence opt2 from VP1__Norovirus_and/or_Norovirus-like__AY532127
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacggccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcacccucacccagaccacccgcgaggacggcuccacccgcgcccacaaggccaccgucuccaccggcuccguccacuucacccccaagcucggcuccgcccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17107 - RNA, 1614 nt, Artificial Sequence
  derived and/or modified sequence opt2 from VP1__Norovirus_and/or_Norovirus-like__AY532118
augaagauggccuccaacgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucggccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccgucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccgacaacgacuuccagaccggccagaacaccaaguucacccccgucggcgucauccaggacggcaacaaccaccagaacgagccccagcaguggguccuccccaacuacuccggccgccccggccacaacguccaccucgcccccgccgucgcccccaccuuccucggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17108 - RNA, 1614 nt, Artificial Sequence
  derived and/or modified sequence opt2 from VP1__Norovirus_and/or_Norovirus-like__KX514326
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccaccaagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccgucgacgaccucgagauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17109 - RNA, 1614 nt, Artificial Sequence
  derived and/or modified sequence opt2 from VP1__Norovirus_and/or_Norovirus-like__KX514264
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguuccagaccgagaccgaggacgaccucgucauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17110 - RNA, 1614 nt, Artificial Sequence
  derived and/or modified sequence opt2 from VP1__Norovirus_and/or_Norovirus-like__KX514171
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcaccacccagcacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17111 - RNA, 1614 nt, Artificial Sequence
  derived and/or modified sequence opt2 from VP1__Norovirus_and/or_Norovirus-like__KX514170
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcaccacccagcacuggaucaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17112 - RNA, 1614 nt, Artificial Sequence
  derived and/or modified sequence opt2 from VP1__Norovirus_and/or_Norovirus-like__KF806533
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgaccucacccacuucgccggcacccacgaguacgccaugaaccucgccucccagaacuggaccaacuacgaccccaccgaggagauccccgccccccucggcgcccccgacuucgucggcaagauccgcggcguccucacccagaccacccgcggcgacggcuccacccgcggccaccgcgccacccucuccaccggcuccgcccacuucacccccaagcucggcuccguccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17113 - RNA, 1614 nt, Artificial Sequence
  derived and/or modified sequence opt2 from VP1__Norovirus_and/or_Norovirus-like__KF806528
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccugggaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucgccggcacccacgaguacgccaugaaccucgccucccagaacuggaacaacuacgaccccaccgaggagauccccgccccccucggcgcccccgacuucgucggcaagauccgcggcguccucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17114 - RNA, 1614 nt, Artificial Sequence
  derived and/or modified sequence opt2 from VP1__Norovirus_and/or_Norovirus-like__KF806527
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgaccucacccacuucgccggcaccuccgaguacgccaugaaccucgccucccagaacuggaccaacuacgaccccaccgaggagauccccgccccccucggcgcccccgacuucgucggcaagauccgcggcguccucacccagaccacccgcggcgacggcuccacccgcggccaccgcgccacccucuccaccggcuccgcccacuucacccccaagcucggcuccguccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17115 - RNA, 1614 nt, Artificial Sequence
  derived and/or modified sequence opt2 from VP1__Norovirus_and/or_Norovirus-like__KX514261
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguuccagaccgagaccgaggacgaccucgucauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17116 - RNA, 1614 nt, Artificial Sequence
  derived and/or modified sequence opt2 from VP1__Norovirus_and/or_Norovirus-like__AB684720
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacauccgcggcucccgcgacuacaccaugaaccucgucucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccgacaacgacuuccagaccggccagaacaccaaguucacccccgucggcgucauccaggacuccgaccaccaccagaacgagccccagcaguggguccuccccaacuacuccggcgccuccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17117 - RNA, 1614 nt, Artificial Sequence
  derived and/or modified sequence opt2 from VP1__Norovirus_and/or_Norovirus-like__LC016605
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccagaucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgacaccgacaccaacaacgaccucgagaccggccagaacacccgcuucacccccgucggcgucauccaggacggcuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 17118 - RNA, 1614 nt, Artificial Sequence
  derived and/or modified sequence opt2 from VP1__Norovirus_and/or_Norovirus-like__KF806529
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucgccggcacccacgaguacgccaugaaccucgccucccagaacugguccaacuacgaccccaccgaggagauccccgccccccucggcgcccccgacuucgucggcaagauccgcggcguccucacccagaccacccgcggcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccgacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17119 - RNA, 1614 nt, Artificial Sequence
  derived and/or modified sequence opt2 from VP1__Norovirus_and/or_Norovirus-like__JX023286
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccgcgucggcaucucccacgacuacaccaugaaccucgucucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggcaccuccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17120 - RNA, 1614 nt, Artificial Sequence
  derived and/or modified sequence opt2 from VP1__Norovirus_and/or_Norovirus-like__FJ537137
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgacuacaccaugaaccucgucucccagaacugguccaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucauccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggccgcaccggccacaacguccaccucgcccccgccgucgcccccaccuuccccggcgagcagcuccucuucuuccgcuccaccguccccggcugcuccggcuaccccaacaugaaccucgacugccuccucccccaggagugggucucccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucguccucccccccaacggcuacuuccgcuucgacuccugggucaaccaguucuacacccucgcccccaugggcaacggcaccggccgccgccgcuga

SEQ ID NO: 17121 - RNA, 1614 nt, Artificial Sequence
  derived and/or modified sequence opt2 from VP1__Norovirus_and/or_Norovirus-like__X76716
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggccaacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgccggcucccacgacuacaccaugaaccucgccucccagaacugguccaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccaggccggccagaacaccaaguucacccccgucggcgucauccaggacggcgaccaccaccagaacgagccccagcaguggcuccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucguccucccccccaacggcuacuuccgcuucgacuccugggucaaccaguucuacacccucgcccccaugggcaacggcaccggccgccgccgcuga

SEQ ID NO: 17122 - RNA, 1614 nt, Artificial Sequence
  derived and/or modified sequence opt2 from VP1__Norovirus_and/or_Norovirus-like__KX514328
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccaccaagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccgucgacgaccucgagauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17123 - RNA, 1614 nt, Artificial Sequence
  derived and/or modified sequence opt2 from VP1__Norovirus_and/or_Norovirus-like__KX514201
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacgucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguucaagaccgagaccgaccacgaccucaccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17124 - RNA, 1614 nt, Artificial Sequence
  derived and/or modified sequence opt2 from VP1__Norovirus_and/or_Norovirus-like__AB985442
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagucccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgacuacaccaugaaccucgccucccagaacugguccaacuacgaccccaccgaggagauccccgccccccucggcacccccgacuucgucggcaagauccagggccuccgcacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17125 - RNA, 1614 nt, Artificial Sequence
  derived and/or modified sequence opt2 from VP1__Norovirus_and/or_Norovirus-like__LC016604
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgacaccgacaccaacaacgaccucgagaccggccagaacacccgcuucacccccgucggcgucauccaggacggcuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 17126 - RNA, 1614 nt, Artificial Sequence
  derived and/or modified sequence opt2 from VP1__Norovirus_and/or_Norovirus-like__KF806532
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgaccucacccacuucgccggcaccuccgaguacgccaugaaccucgccucccagaacuggaccaacuacgaccccaccgaggagauccccgccccccucggcgcccccgacuucgucggcaagauccgcggcguccucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucacccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17127 - RNA, 1614 nt, Artificial Sequence
  derived and/or modified sequence opt2 from VP1__Norovirus_and/or_Norovirus-like__FJ537138
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccgcgucggcaucucccacgacuacaccaugaaccucgucucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggcaccuccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17128 - RNA, 1614 nt, Artificial Sequence
  derived and/or modified sequence opt2 from VP1__Norovirus_and/or_Norovirus-like__AY030098
augaagauggccuccuccgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagucccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgacuacaccaugaaccucgucucccagaacugguccaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccgacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17129 - RNA, 1614 nt, Artificial Sequence
  derived and/or modified sequence opt2 from VP1__Norovirus_and/or_Norovirus-like__AY532130
augaagauggccuccaacgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuccaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaucaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccgcccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugcgcaacggcgccggccgccgccgcuga

SEQ ID NO: 17130 - RNA, 1614 nt, Artificial Sequence
  derived and/or modified sequence opt2 from VP1__Norovirus_and/or_Norovirus-like__KX514286
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcuccgccgacuucacccccaagcucggcaagguccaguucgagaccgacaccgaggacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17131 - RNA, 1614 nt, Artificial Sequence
  derived and/or modified sequence opt2 from VP1__Norovirus_and/or_Norovirus-like__KX514202
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguucaagaccgagaccgaccacgaccucaccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17132 - RNA, 1614 nt, Artificial Sequence
  derived and/or modified sequence opt2 from VP1__Norovirus_and/or_Norovirus-like__DQ358208
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggccaacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgccggcucccacgacuacaccaugaaccucgccucccagaacugguccaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccaggccggccagaacaccaaguucacccccgucggcgucauccaggacggcgaccaccaccagaacgagccccagcaguggucccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucguccucccccccaacggcuacuuccgcuucgacuccugggucaaccaguucuacacccucgcccccaugggcaacggcaccggccgccgccgcuga

SEQ ID NO: 17133 - RNA, 1614 nt, Artificial Sequence
  derived and/or modified sequence opt2 from VP1__Norovirus_and/or_Norovirus-like__AF414425
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgccuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgccuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccaguccggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuucaaguccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17134 - RNA, 1614 nt, Artificial Sequence
  derived and/or modified sequence opt2 from VP1__Norovirus_and/or_Norovirus-like__KX514348
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccaccaagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccgucgacgaccucgagauccgccagaacaccaaguucacccccgucggcgucauccaguccuccgaccaccaccgcgacgagccccagcaguggguccuccccuccuacuccggccgcgacacccccaacguccaccucgcccccgccgucgcccccaacuuccccggcgagcagcuccucuucuuccgcuccacccuccccggcugcggcggccaccacaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17135 - RNA, 1614 nt, Artificial Sequence
  derived and/or modified sequence opt2 from VP1__Norovirus_and/or_Norovirus-like__KX514287
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccacccaccacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcuccgccgacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17136 - RNA, 1614 nt, Artificial Sequence
  derived and/or modified sequence opt2 from VP1__Norovirus_and/or_Norovirus-like__KX514183
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcaccacccagcacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17137 - RNA, 1614 nt, Artificial Sequence
  derived and/or modified sequence opt2 from VP1__Norovirus_and/or_Norovirus-like__KX514174
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcaccacccagcacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17138 - RNA, 1614 nt, Artificial Sequence
  derived and/or modified sequence opt2 from VP1__Norovirus_and/or_Norovirus-like__KF429791
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccggccaggucaccauguucccccacaucaucgucgacguccgccagcucgagcccguccucaucccccuccccgacguccgcaacaacuucuaccacuacaaccaguccaacgaccccaccaucaagcucgucgccaugcucuacaccccccuccgcgccaacaacgccggcgacgacgucuucaccgucuccugccgcguccucacccgccccucccccgacuucgacuucaucuuccucgucccccccaccaucgaguccaagaccaaguccuucuccguccccauccucaccaucgaggagaugaccaacucccgcuuccccaucccccucgagaagcucuucaccggccccuccuccacccucgucguccagccccagaacggccgcugcaccaccgacggcguccuccucggcaccacccagcucucccccgucaacaucugcaccuuccgcggcgacgucacccagaucaccaacacccacuccuacgagaugaaccucgccgcccagaacuggaacuccuacgaccccaccgaggagauccccgccccccucggcacccccgacuucgucggcaagauccagggcguccucacccagaccaccaaggagaacggcuccacccgcgcccacaaggccaccgucuacaccggcuccaccggcuucacccccaagcucggccgcguccaguucgucaccgacaccgaccgcgaccucgagaccaaccaggacaccaaguucacccccgucggcgucauccaggacggcgacgcccaccagaacgagccccagcaguggguccuccccuccuaccucggcaccaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccgccacgaccucgucaucccccccaacggcuacuuccgcuucgacuccugggucucccccuucuacacccucgcccccaugggcaacggcaccggccgccgccgcuga

SEQ ID NO: 17139 - RNA, 1614 nt, Artificial Sequence
  derived and/or modified sequence opt2 from VP1__Norovirus_and/or_Norovirus-like__AF427115
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccauccccauccucaccggcgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuucaagggcaacgucauccacaucgccggcucccacgacuacaccaugaaccucgccucccagaacuggaacaacuacgaccccaccgaggagacccccgccccccucggcacccccgacuucgucggcaagauccagggccuccucacccagaccacccgcgaggacggcuccacccgcgcccacaaggccaccgucuccgccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcgccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17140 - RNA, 1614 nt, Artificial Sequence
  derived and/or modified sequence opt2 from VP1__Norovirus_and/or_Norovirus-like__KX514314
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccaccaagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17141 - RNA, 1614 nt, Artificial Sequence
  derived and/or modified sequence opt2 from VP1__Norovirus_and/or_Norovirus-like__KX514208
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguucaagaccgagaccgaccacgaccucuccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17142 - RNA, 1614 nt, Artificial Sequence
  derived and/or modified sequence opt2 from VP1__Norovirus_and/or_Norovirus-like__KX514206
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguucaagaccgagaccgaccacgaccucuccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17143 - RNA, 1614 nt, Artificial Sequence
  derived and/or modified sequence opt2 from VP1__Norovirus_and/or_Norovirus-like__KX514198
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguucaagaccgagaccgaccacgaccucaccacccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17144 - RNA, 1614 nt, Artificial Sequence
  derived and/or modified sequence opt2 from VP1__Norovirus_and/or_Norovirus-like__KX514191
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcaccacccgccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17145 - RNA, 1614 nt, Artificial Sequence
  derived and/or modified sequence opt2 from VP1__Norovirus_and/or_Norovirus-like__KX514187
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcaccacccgccacuggaccaugaaccucgucucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17146 - RNA, 1614 nt, Artificial Sequence
  derived and/or modified sequence opt2 from VP1__Norovirus_and/or_Norovirus-like__KX514180
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucauccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccacccagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcuccgccaacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17147 - RNA, 1614 nt, Artificial Sequence
  derived and/or modified sequence opt2 from VP1__Norovirus_and/or_Norovirus-like__GU598213
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgacuccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacugguccaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucugccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17148 - RNA, 1614 nt, Artificial Sequence
  derived and/or modified sequence opt2 from VP1__Norovirus_and/or_Norovirus-like__KX514365
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagauccgcuccacccagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcuccgccaacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17149 - RNA, 1614 nt, Artificial Sequence
  derived and/or modified sequence opt2 from VP1__Norovirus_and/or_Norovirus-like__KX514304
augaagauggucuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccaccaagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17150 - RNA, 1614 nt, Artificial Sequence
  derived and/or modified sequence opt2 from VP1__Norovirus_and/or_Norovirus-like__KX514302
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccacccagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggccgcguccaguucgagaccgacaccaccgacgaccucgacgcccaccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17151 - RNA, 1614 nt, Artificial Sequence
  derived and/or modified sequence opt2 from VP1__Norovirus_and/or_Norovirus-like__KX514207
augaagauggccuccuccgacgccaaccccuccgacggcuccgccgccaaccucguccccgaggucaacaacgaggucauggcccucgagcccgucgucggcgccgccaucaccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgucucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguucaagaccgagaccgaccacgaccucuccauccgccagaacaccaaguucacccccgucggcgucauccaggaguccgaccaccaccgcgacgagccccagcaguggcgccuccccaacuacuccggcgccaacgccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17152 - RNA, 1614 nt, Artificial Sequence
  derived and/or modified sequence opt2 from VP1__Norovirus_and/or_Norovirus-like__KX514192
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcgccacccgccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17153 - RNA, 1614 nt, Artificial Sequence
  derived and/or modified sequence opt2 from VP1__Norovirus_and/or_Norovirus-like__KF806525
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccuacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgaccucacccacuucgccggcaccuccgaguacgccaugaaccucgccucccagaacuggaccaacuacgaccccaccgaggagauccccgccccccucggcgcccccgacuucgucggcaagauccgcggcguccucacccagaccacccgcggcgacggcuccacccgcggccaccgcgccacccucuccaccggcuccgcccacuucacccccaagcucggcuccguccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17154 - RNA, 1614 nt, Artificial Sequence
  derived and/or modified sequence opt2 from VP1__Norovirus_and/or_Norovirus-like__KC462195
augaagauggccuccaacgacaccauccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccaugccccucucccccgaccucaaccccuaccucucccaccucucccgcauguacaacggcuacgccggcggcuucgagguccaggucauccucgccggcaacgccuucaccgccggcaagaucaucuucgccgccaucccccccaacuuccccaccgacggccucucccccucccaggucaccauguucccccacaucaucgucgacguccgccagcucgagcccguccucaucccccuccccgacguccgcaacaacuucuaccacuacaaccaggucaacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgacgagaugaccaacucccgcuuccccaccccccucgagcgccuccacaccggccccaacaacucccucgucguccagccccagaacggccgcugcaccaucgacggcguccuccucggcaccacccagcucuccgccgucaacaucugcuccuuccgcggcgacuccaccacccgcgagggccagucccacgccuacaccaugaaccucgccucccagaacuggaccaacuacgaccccaccgaggacauccccgccccccucggcacccccgacuucgucggcaagaucgucggcaugcucucccagaccacccgcgagaacuccuccacccgcgcccacaaggccaccgucuccaccggcgacgcccacuucaugcccaagcucggcuccguccucuucaccaccgacaccgaggaccuccagaacggccagaacacccgcuucacccccgucggcgucgcccaggacggcgagccccaccagaacgagccccagcaguggcgccuccccaacuacuccggcacccccggccacaacguccaccucgccccccccgucgcccccaccuuccccggcgagcagcuccucuucuuccgcuccaccaugcccggcugcggcggcuaccccaacauggaccucgacugccuccucccccaggaguggguccgccacuucuaccaggaggccgcccccgcccaguccgacgucgcccuccuccgcuucgucaaccccgacaccggccgcguccucuucgagugcaagcuccacaaggccggcuacaucaccgucucccacaccggccccuacgaccucgucaucccccccaacggcuacuuccgcuucgacuccugggucaaccaguucuacgcccucgcccccaugggcaccggcaccggccgccgccgcuga

SEQ ID NO: 17155 - RNA, 1614 nt, Artificial Sequence
  derived and/or modified sequence opt2 from VP1__Norovirus_and/or_Norovirus-like__AF427116
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccauccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcaacgucauccacaucgccggcucccacgacuacaccaugaaccucgccucccagaacuggaacaacuacgaccccaccgaggagacccccgccccccucggcaccuccgacuucgucggcaagauccagggccuccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcgccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17156 - RNA, 1614 nt, Artificial Sequence
  derived and/or modified sequence opt2 from VP1__Norovirus_and/or_Norovirus-like__KX514337
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcgccacccgccacuggaccaugaaccucgccucccccaacuggaacaacuacgaccccaccgaggagacccccgccccccucggcacccccgacuucgucggcaagguccacggcaugcucacccagaccacccagggcuccggcuccacccgcgcccaccgcgccaccgucuacgucggcggcgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17157 - RNA, 1614 nt, Artificial Sequence
  derived and/or modified sequence opt2 from VP1__Norovirus_and/or_Norovirus-like__KX514255
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcuccgccgacuucacccccaagcucggcaagguccaguucgagaccgagaccgacuacgaccucgccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17158 - RNA, 1614 nt, Artificial Sequence
  derived and/or modified sequence opt2 from VP1__Norovirus_and/or_Norovirus-like__KX514210
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguucaagaccgagaccgaccacgaccucuccacccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17159 - RNA, 1614 nt, Artificial Sequence
  derived and/or modified sequence opt2 from VP1__Norovirus_and/or_Norovirus-like__KX514182
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcaccacccagcacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgcaagcgcuga

SEQ ID NO: 17160 - RNA, 1614 nt, Artificial Sequence
  derived and/or modified sequence opt2 from VP1__Norovirus_and/or_Norovirus-like__AF425764
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcggcuucaccgucuccccccgcaacgcccccggcgagauccucugguccgccccccucggccccgaccucaaccccuaccucucccaccucgcccgcauguacaacggcuacgccggcggcuucgagguccaggucauccucgccggcuccgccuccaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17161 - RNA, 1614 nt, Artificial Sequence
  derived and/or modified sequence opt2 from VP1__Norovirus_and/or_Norovirus-like__KX514355
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccacccagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccuccgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17162 - RNA, 1614 nt, Artificial Sequence
  derived and/or modified sequence opt2 from VP1__Norovirus_and/or_Norovirus-like__KX514345
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcgccacccgccacuggaccaugaaccucgccucccucaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcgccgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17163 - RNA, 1614 nt, Artificial Sequence
  derived and/or modified sequence opt2 from VP1__Norovirus_and/or_Norovirus-like__KX514204
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcggcgccgaguucacccccaagcucggcaagguccaguucaagaccgagaccgaccacgaccucuccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17164 - RNA, 1614 nt, Artificial Sequence
  derived and/or modified sequence opt2 from VP1__Norovirus_and/or_Norovirus-like__KF712492
augaagauggccuccuccgacgccaaccccuccgacggcuccaccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucgccgccggcaagaucaucuucgccgccgucccccccaacuuccccaccgagggccucucccccucccaggucaccauguucccccaccucaucgucgacguccgccagcucgagcccgucaugaucccccuccccgacauccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgaguccaagaccaaccccuucuccguccccauccucaccaucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaccaccaagacccacaccuaccagaugaaccucgccgcccagaacuggaacuccuacgaccccaccgaggagauccccgccccccucggcacccccgacuucgucggcaagauccagggcguccucacccagaccaccaagggcaacggcuccacccgcgcccacaaggccaccgucuacaccggcuccgccgaguucacccccaagcucggccgcauccagcucuucaccgacaccgacaacgaccucgaggccaaccagaacaccaaguucacccccgucggcgucauccaggacggcgacacccaccagaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaccacgaccucuucaucccccccaacggcuacuuccgcuucgacuccugggucucccccuucuacacccucgcccccaugggcaacggcaccggccgccgccgcuga

SEQ ID NO: 17165 - RNA, 1614 nt, Artificial Sequence
  derived and/or modified sequence opt2 from VP1__Norovirus_and/or_Norovirus-like__DQ078829
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccccucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgaccccguccucauccccucccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaucaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccaggacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccagcccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17166 - RNA, 1614 nt, Artificial Sequence
  derived and/or modified sequence opt2 from VP1__Norovirus_and/or_Norovirus-like__KX514370
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcgccacccgccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcggcgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17167 - RNA, 1614 nt, Artificial Sequence
  derived and/or modified sequence opt2 from VP1__Norovirus_and/or_Norovirus-like__KX514332
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccaccaagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccgucgacgaccucgagauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17168 - RNA, 1614 nt, Artificial Sequence
  derived and/or modified sequence opt2 from VP1__Norovirus_and/or_Norovirus-like__KX514276
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcaccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17169 - RNA, 1614 nt, Artificial Sequence
  derived and/or modified sequence opt2 from VP1__Norovirus_and/or_Norovirus-like__KX514256
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagggccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacuccuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguucaagaccgagaccaaccacgaccucuccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccucccccccaacggcuacuuccgcuucgacuccugggucaaccaguucuacacccucgcccccaugggcaacggcaccggccgccgccgcuga

SEQ ID NO: 17170 - RNA, 1614 nt, Artificial Sequence
  derived and/or modified sequence opt2 from VP1__Norovirus_and/or_Norovirus-like__KX514209
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgaccucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguucaagaccgagaccgaccacgaccucuccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17171 - RNA, 1614 nt, Artificial Sequence
  derived and/or modified sequence opt2 from VP1__Norovirus_and/or_Norovirus-like__KX514205
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcggcgccgaguucacccccaagcucggcaagguccaguucaagaccgagaccgaccacgaccucuccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17172 - RNA, 1614 nt, Artificial Sequence
  derived and/or modified sequence opt2 from VP1__Norovirus_and/or_Norovirus-like__KX514200
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucucccccgucaacaucugcaccuuccgcggcgacgucacccacaucggcaccacccgccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguucaagaccgagaccgaccacgaccucuccauccgccagaacaccaaguucacccccgucggcgucauccagaaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17173 - RNA, 1614 nt, Artificial Sequence
  derived and/or modified sequence opt2 from VP1__Norovirus_and/or_Norovirus-like__KX514196
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgucuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcggcgccgaguucacccccaagcucggcaagguccaguucaagaccgagaccgaccacgaccucaccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17174 - RNA, 1614 nt, Artificial Sequence
  derived and/or modified sequence opt2 from VP1__Norovirus_and/or_Norovirus-like__AB985437
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgacuacaccaugaaccucgucucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggcaccuccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccuccuacaucaccgucgcccacaccggccccuacgaccucgucaucccccccaacggcuacuuccgcuucgacuccugggucaaccacuucuacacccucgcccccaugggcaacggcaccggcggccgccgcuga

SEQ ID NO: 17175 - RNA, 1614 nt, Artificial Sequence
  derived and/or modified sequence opt2 from VP1__Norovirus_and/or_Norovirus-like__KF712494
augaagauggccuccuccgacgccaaccccuccgacggcuccaccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagguccucugguccgccccccucggccccgaccucaaccccuaccucucccaccucgcccgcauguacaacggcuacgccggcggcuucgagguccaggucauccucgccggcaacgccuucgccgccggcaagaucaucuucgccgccgucccccccaacuuccccaccgagggccucucccccucccaggucaccauguucccccaccucaucaucgacguccgccagcucgagcccgucaugaucccccuccccgacguccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgaguccaagaccaaccccuucuccguccccauccucaccaucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaucaccaagacccacuccuaccagaugaaccucgccgcccagaacuggaacuccuacgaccccaccgaggagauccccgccccccucggcacccccgacuucgucggcaagauccagggcguccucacccagaccaccaagggcaacggcuccacccgcgcccacaaggccaccgucuacaccggcuccaccgaguucacccccaagcucggccgcauccagcucgucaccgacaccgacaacgaccucgagaccaaccagaacaccaaguucacccccgucggcgucauccaggacggcgacacccaccagaacgagccccagcaguggguccuccccuccuaccucggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaccacgaccucuucaucccccccaacggcuacuuccgcuucgacuccugggucucccccuucuacacccucgcccccaugggcaacggcaccggccgccgccgcuga

SEQ ID NO: 17176 - RNA, 1614 nt, Artificial Sequence
  derived and/or modified sequence opt2 from VP1__Norovirus_and/or_Norovirus-like__KX514315
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccaccaagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17177 - RNA, 1614 nt, Artificial Sequence
  derived and/or modified sequence opt2 from VP1__Norovirus_and/or_Norovirus-like__KX514199
augaagauggccuccuccgacgccaaccccuccgacggcuccgccgccaaccucguccccgaggucaacaacgaggucauggcccucgagcccgucgucggcgccgccaucgucgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguucaagaccgagaccgaccacgaccucaccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccuccacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17178 - RNA, 1614 nt, Artificial Sequence
  derived and/or modified sequence opt2 from VP1__Norovirus_and/or_Norovirus-like__KX514176
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccgcaucggcaccacccagcacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17179 - RNA, 1614 nt, Artificial Sequence
  derived and/or modified sequence opt2 from VP1__Norovirus_and/or_Norovirus-like__KX514360
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccaccaagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17180 - RNA, 1614 nt, Artificial Sequence
  derived and/or modified sequence opt2 from VP1__Norovirus_and/or_Norovirus-like__KX514347
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaguccggcaacaccaagaucuacaccaugaaccucgccucccccaacuggaacaacuacgaccccaccgaggagauccccgccccccucggcacccccgacuucgucggcaagauccacggcaugcucacccagaccacccagggcuccggcuccacccgcgcccaccgcgccaccgucuacgucggcggcgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucguccuccccuccaacggcuacuuccgcuucgacuccugggucaaccaguucuacacccucgcccccaugggcaacggcaccggccgccgccgcuga

SEQ ID NO: 17181 - RNA, 1614 nt, Artificial Sequence
  derived and/or modified sequence opt2 from VP1__Norovirus_and/or_Norovirus-like__AB684675
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccucggcgacgucacccgcgucggcaccucccacgacuacaccaugaaccucgucucccagaacugggacaacuacgaccccaccgaggagauccccgccccccucggcacccccgacuucgucggcaagauccagggccuccucacccagaccacccgcgccgaccgcuccacccccgcccacaaggccaccgucuccaccggcuccguccacuucacccccaagcucggcuccguccaguucaccaccgacaccaacaacgacuuccagaccggccagaacaccaaguucacccccgucggcgucauccaggacuccgaccaccaccagaacgagccccagcaguggguccuccccaacuacuccggcaccaccggccacaacguccaccucgcccccgccgucgcccccaccuuccccggcgagcagcuccucuucuuccgcgucaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17182 - RNA, 1614 nt, Artificial Sequence
  derived and/or modified sequence opt2 from VP1__Norovirus_and/or_Norovirus-like__KX514369
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcgccacccgccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcggcgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17183 - RNA, 1614 nt, Artificial Sequence
  derived and/or modified sequence opt2 from VP1__Norovirus_and/or_Norovirus-like__KX514310
augaagauggccuccaacgacaccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacuccaagaucuacaccaugaaccucgccucccccaacuggaacaacuacgaccccaccgaggagauccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17184 - RNA, 1614 nt, Artificial Sequence
  derived and/or modified sequence opt2 from VP1__Norovirus_and/or_Norovirus-like__KX514185
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcggccuccucggcaccacccagcucuccuccgucaacaucugcaccuuccgcggcgacgucacccacaucggcaccacccgccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17185 - RNA, 1614 nt, Artificial Sequence
  derived and/or modified sequence opt2 from VP1__Norovirus_and/or_Norovirus-like__KX514181
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcaguucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcaccacccgccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgagcaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17186 - RNA, 1614 nt, Artificial Sequence
  derived and/or modified sequence opt2 from VP1__Norovirus_and/or_Norovirus-like__KF712493
augaagauggccuccuccgacgccaaccccuccgacggcuccaccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagguccucugguccgccccccucggccccgaccucaaccccuaccucucccaccucgcccgcauguacaacggcuacgccggcggcuucgagguccaggucauccucgccggcaacgccuucgccgccggcaagaucaucuucgccgccgucccccccaacuuccccaccgagggccucucccccucccaggucaccauguucccccaccucaucgucgacguccgccagcucgagcccgucaugaucccccuccccgacauccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgaguccaagaccaaccccuucuccguccccauccucaccaucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaccaccaagacccacaccuaccagaugaaccucgccgcccagaacuggaacuccuacgaccccaccgaggagauccccgccccccucggcacccccgacuucgucggcaagauccagggcguccucacccagaccaccaagggcaacggcuccacccgcgcccacaaggccaccgucuacaccggcggcgucgaguucacccccaagcucggccgcauccagcucuucaccgacaccgacaacgaccucgaggccaaccagaacaccaaguucacccccgucggcgucauccaggacggcgacacccaccagaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaccacgaccucuucaucccccccaacggcuacuuccgcuucgacuccugggucucccccuucuacacccucgcccccaugggcaacggcaccggccgccgccgcuga

SEQ ID NO: 17187 - RNA, 1614 nt, Artificial Sequence
  derived and/or modified sequence opt2 from VP1__Norovirus_and/or_Norovirus-like__FJ411169
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgccgacgucuucaccgucucccgccgcguccucacccgccccucccccgacuucgacuucaucuucuccgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17188 - RNA, 1614 nt, Artificial Sequence
  derived and/or modified sequence opt2 from VP1__Norovirus_and/or_Norovirus-like__AF427121
augaagauggccuccaacgacgccaaccccuccgacggcuccaccgccaaccucguccccgaggucaacaacgaggucaugacccucgagcccgucgucggcgccgccaucgccgcccccgucgccggccagcagaacgucaucgaccccuggaucggcaacaacaucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccgucuucccccacaucaucgucgacguccgccagcucgagcccguccucaucccccuccccgacguccgcaacaacuuccaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccaucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccuccaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaacuccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17189 - RNA, 1614 nt, Artificial Sequence
  derived and/or modified sequence opt2 from VP1__Norovirus_and/or_Norovirus-like__KF429787
augaagauggccuccaacgacgccacccccuccgacggcuccuccgccaaccucguccccgaggccaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccucccucggccccgaccucaaccccuaccucucccaccucucccgcauguacaacggcuacgccggcuccuucgagguccaggucauccucgccggcaacgccuucaccgccggcaagaucaucuucgccgccgucccccccaacuuccgcaccgagggccucucccccucccagaucaccauguucccccacaucaucaccgacguccgccagcucgagcccguccucaucccccuccccgacauccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccgcaucggcaacucccgcgaguaccgcaugaaccucgccucccucaacuggaacaacuacgaccccaccgaggagauccccgccccccucggcacccccgacuucgccggcaagauccagggcguccucacccagaccacccgccacgacggcuccacccgcggccacaaggccaccgucuacaccggcuccgccggcuucacccccaagcucggcuccguccaguucuccaccgacaccgacaacgaccucgaggccaaccagaacacccgcuucacccccgucggcgucauccaggacggcaacgcccaccagggcgagccccagcaguggguccuccccaacuacgccggccgcgacggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17190 - RNA, 1614 nt, Artificial Sequence
  derived and/or modified sequence opt2 from VP1__Norovirus_and/or_Norovirus-like__AB933728
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccaucccccccaacuuccccaccgagggccucucccccucccaggucaccauguucccccacaucgucgucgacguccgccagcucgagcccguccucaucccccuccccgacguccgcaacaacuucuaccacuacaaccagaccaaggaguccaccaucaagcucgucgccaugcucuacaccccccuccgcgccaacaacgccggcgacgacgucuucaccgucuccugccgcguccucacccgccccucccccgacuucgacuucaucuuccucgucccccccuccgucgagucccgcaccaagcccuucaccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccgcgucuccaccacccacgucuacgagaugaaccucgccucccagaacuggaacaacuacgaccccaccgaggagguccccgccccccucggcacccccgacuucgucggcaagauccagggcguccucacccagaccacccgcaccgacggcuccacccgcgcccacaaggccaccgucuccaccggcgccgccgacuucacccccaagcucggcuccauccgcuucgagaccaccaccaaccgcgaccucgagacccaccagaacaccaaguucacccccgucggcgucauccaggacggcgacaaccaccagaacgagccccagcaguggcgccuccccggcuacgccggccgcgacgcccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuaccucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17191 - RNA, 1614 nt, Artificial Sequence
  derived and/or modified sequence opt2 from VP1__Norovirus_and/or_Norovirus-like__KX514346
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccaccaagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcuccaacuucacccccaagcucggcaagguccccuucgagaccgacaccggcgacgaccucgccauccgccagaacaccaaguucacccccgucggcgucauccaguccuccggccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17192 - RNA, 1614 nt, Artificial Sequence
  derived and/or modified sequence opt2 from VP1__Norovirus_and/or_Norovirus-like__KX514249
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgaccucaucuuccucgucccccccaccgucgagucccgcaccaagcccuucuccguccccauccucaccgucggcgagaugaccaacucccgcuuccccaucaaccucgagggccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcggcgccgaguucacccccaagcucggcaagguccaguucaagaccgagaccaaccacgaccucuccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17193 - RNA, 1614 nt, Artificial Sequence
  derived and/or modified sequence opt2 from VP1__Norovirus_and/or_Norovirus-like__KF429760
augaagauggccuccaacgacgccacccccuccgacggcuccuccgccaaccucguccccgaggucaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccucccucggccccgaccucaaccccuaccucucccaccucucccgcauguacaacggcuacgccggcuccuucgagguccaggucauccucgccggcaacgccuucaccgccggcaagaucaucuucgccgccgucccccccaacuuccgcaccgagggccucucccccucccagaucaccauguucccccacaucaucaccgacguccgccagcucgagcccguccucaucccccuccccgacauccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccgcaucggcaacucccgcgaguaccgcaugaaccucgccucccucaacuggaacaacuacgaccccaccgaggagauccccgccccccucggcacccccgacuucgccggcaagauccagggcguccucacccagaccacccgccacgacggcuccacccgcggccacaaggccaccgucuacaccggcuccgccggcuucacccccaagcucggcuccguccaguucuccaccgacaccgacaacgaccucgaggccaaccagaacacccgcuucacccccgucggcgucauccaggacggcaacgcccaccagggcgagccccagcaguggguccuccccaacuacgccggccgcgacggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcuga

SEQ ID NO: 17194 - RNA, 1614 nt, Artificial Sequence
  derived and/or modified sequence opt2 from VP1__Norovirus_and/or_Norovirus-like__AB303929
augaagauggccuccaacgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuacaccggccccuccuccgccaucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucuccaccgacaccgacaacgacuuccagcccggccagaacaccaaguucacccccgucggcgucauccaggacggcgaccgccaccagaacgagccccagcaguggguccuccccgacuucuccggccgcaccggccacaacguccaccucgcccccgccgucgcccccaccuuccccggcgagcagcuccucuucuuccgcuccaccaugcccggccgcuccggcuaccccaacaugaaccucgacugccuccucccccaggaguggguccuccacuucuaccaggaguccgcccccgcccaguccgacgucgcccuccuccgcuucgucaaccccgacaccaaccgcguccucuucgagugcaagcuccacaaguccggcuacaucaccgucgcccacaccggccaccacgaccucauccucccccccaacggcuacuuccgcuucgacuccugggucaaccaguucuacacccucgcccccaugggcaacggcgccggccgccgccgcuga

SEQ ID NO: 17195 - RNA, 1614 nt, Artificial Sequence
  derived and/or modified sequence opt2 from VP1__Norovirus_and/or_Norovirus-like__KX514363
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccacccagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccgcuucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17196 - RNA, 1614 nt, Artificial Sequence
  derived and/or modified sequence opt2 from VP1__Norovirus_and/or_Norovirus-like__KX514357
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgacuucacccccaagcucggcaagguccaguucgagaccgagaccgaccacgaccucgccauccgccagaacaccaaguucacccccgucggcgucauccaggaguccgacaaccaccgcgacgagccccagcaguggcgccuccccaacuacuccggcgccaacaccuucaacguccaccucgcccccgccgucgcccccaacuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17197 - RNA, 1614 nt, Artificial Sequence
  derived and/or modified sequence opt2 from VP1__Norovirus_and/or_Norovirus-like__KX514240
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccaguuccagaccgagaccgaggacgaccucgucauccgccagaacaccaaguucacccccgucggcgucauccaggaguccgaccaccaccgcgacgagccccagcaguggguccuccccuccuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17198 - RNA, 1614 nt, Artificial Sequence
  derived and/or modified sequence opt2 from VP1__Norovirus_and/or_Norovirus-like__AF414417
augaagauggccuccaacgacgccaaccccuccgacggcuccgccgccaaccucguccccgaggucaacaacgaggucauggcccucgagcccgucgucgacgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccccaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccaugcucaucccccuccccgacguccgcaacaacuucuaccacuacaaccaggccaacgacuccacccucaagcucaucgccacccucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucgcccacaucgccggcucccacgacuacaccaugaaccucgccucccagaacugguccaacuacgaccccaccgaggagauccccgccccccucggcacccccgacuucgucggcaagauccagggccuccucacccagaccacccgcgccgacggccucacccgcgcccacaaggccaccgucuccaccggcuccguccacuucacccccaagcucggcuccguccaguucaccaccgacaccaacaacgacuuccaggccggccagaacaccaaguucacccccgucggcgucauccaggacggcgaccaccaccagaacgagccccagcaguggcuccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucguccucccccccaacggcuacuuccgcuucgacuccugggucaaccaguucuacacccucgcccccaugggcaacggcaccggccgccgccgcuga

SEQ ID NO: 17199 - RNA, 1614 nt, Artificial Sequence
  derived and/or modified sequence opt2 from VP1__Norovirus_and/or_Norovirus-like__KX514303
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccacccgccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17200 - RNA, 1614 nt, Artificial Sequence
  derived and/or modified sequence opt2 from VP1__Norovirus_and/or_Norovirus-like__KX514273
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucaccggcaagauccagggcaugcucacccagaccaccaagggcgagggcuccacccgcggccaccgcgccaccgucuacgucggcuccgccgaguucacccccaagcucggcaagguccgcuucgagaccgacaccgaggacgaccucgucauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17201 - RNA, 1614 nt, Artificial Sequence
  derived and/or modified sequence opt2 from VP1__Norovirus_and/or_Norovirus-like__KX514323
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaccccggcaacuccaagaucuacaccaugaaccucgccucccccaacuggaacaacuacgaccccaccgaggagauccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17202 - RNA, 1614 nt, Artificial Sequence
  derived and/or modified sequence opt2 from VP1__Norovirus_and/or_Norovirus-like__KX514364
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccaccaagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgccccccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17203 - RNA, 1614 nt, Artificial Sequence
  derived and/or modified sequence opt2 from VP1__Norovirus_and/or_Norovirus-like__KX514338
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaacuucgucguccagccccagaacggccgcugcaugaucgacggcguccuccucggcaccacccagcucucccccgucaacaucugcaccuuccgcggcgacgucacccagaucggcuccaccaagcacuggaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccgucgacgaccucgagauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17204 - RNA, 1614 nt, Artificial Sequence
  derived and/or modified sequence opt2 from VP1__Norovirus_and/or_Norovirus-like__KX514316
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacuccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcuccgccaacuacgcccccaagcucggccgcguccaguucgagaccgacaccaccgacgaccucgacgcccaccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgcaagcgcuga

SEQ ID NO: 17205 - RNA, 1614 nt, Artificial Sequence
  derived and/or modified sequence opt2 from VP1__Norovirus_and/or_Norovirus-like__KX514356
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacugcuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaucaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgacuucacccccaagcucggcaagguccaguucgagaccgagaccgaccacgaccucgccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17206 - RNA, 1614 nt, Artificial Sequence
  derived and/or modified sequence opt2 from VP1__Norovirus_and/or_Norovirus-like__KX514349
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaguccggcaacaccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcggcgccgaguucacccccaagcucggcaagguccgcuucgagaccgacaccgaggacgaccucgucauccgccagaacaccaaguucacccccgucggcgucauccagaccuccgagaaccaccgcgacgagccccagcaguggcgccuccccaacuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17207 - RNA, 1614 nt, Artificial Sequence
  derived and/or modified sequence opt2 from VP1__Norovirus_and/or_Norovirus-like__KX514217
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccacccagggcuccggcuccacccgcgcccaccgcgccaccgucuacgucggcuccgccgaguucacccccaagcucggcaagguccaguuccagaccgagaccgaccacgaccucgucauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17208 - RNA, 1614 nt, Artificial Sequence
  derived and/or modified sequence opt2 from VP1__Norovirus_and/or_Norovirus-like__KX514324
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacuccggcaacuccaagaucuacaccaugaaccucgccucccccaacuggaacaacuacgaccccaccgaggagauccccgccccccucggcacccccgacuucgucggcaagauccagggcaugcucacccagaccaccaagggcgagggcuccacccgcggccaccgcgccaccgucuacgucggcggcgccaacuucacccccaagcucggcaagguccaguucgagaccgacaccgucgacgaccucgagauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17209 - RNA, 1614 nt, Artificial Sequence
  derived and/or modified sequence opt2 from VP1__Norovirus_and/or_Norovirus-like__KX514306
augaagauggccuccuccgacgccaaccccuccgacggcuccaccgccaaccucguccccgaggucaacaacgaggucauggcccucgagcccgucgucggcgucgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaucgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccagaucggcuccacccagcacuggaccaugaaccucgccucccccaacuggaacaacuacgaccccaccgaggagacccccgccccccucggcacccccgacuucgucggcaagauccagggcaugcucacccagaccacccaggagaacggcuccacccgcgcccaccgcgccaccgucuacgucggcggcgccaacuacgcccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucacccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17210 - RNA, 1614 nt, Artificial Sequence
  derived and/or modified sequence opt2 from VP1__Norovirus_and/or_Norovirus-like__AB186063
augaagauggccuccaacgacgucaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucuccaccgacaccgacaacgacuuccagcccggccagaacaccaaguucacccccgucggcgucauccaggacggcgaccgccaccagaacgagccccagcaguggguccuccccgacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaguccgcccccgcccaguccgacgucgcccuccuccgcuucgucaaccccgacaccaaccgcguccucuucgagugcaagcuccacaaguccggcuacaucaccgucgcccacaccggccagcacgaccucauccucccccccaacggcuacuuccgcuucgacuccugggucaaccaguucuacacccucgcccccaugggcaacggcgccggccgccgccgcuga

SEQ ID NO: 17211 - RNA, 1614 nt, Artificial Sequence
  derived and/or modified sequence opt2 from VP1__Norovirus_and/or_Norovirus-like__AF406793
augaagauggccuccuccgacgccaaccccuccgacggcuccaccgccaaccucguccccgaggucaacaacgaggucauggcccucgagcccgucgucggcgccgccaucgccggccccgucgccggccagcagaacgucaucgaccccuggauccgcaacaacuucguccaggcccccggcggcgaguucaccgucucccccaccaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacgcccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgucuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgccaccaaggccaccgucuccaccggcuccguccacuucacccccaagcucggcuccguccaguacaccgccgacaccaacaacgacuuccagaccggccagaacaccaaguucacccccgucggcgucauccaggacggcuccaaccaccagaacgagccccagcaguggguccucaccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgaccccugggucaaccaguucuacacccucgcccccaugggcaacggcgccggccgccgccgcuga

SEQ ID NO: 17212 - RNA, 1614 nt, Artificial Sequence
  derived and/or modified sequence opt2 from VP1__Norovirus_and/or_Norovirus-like__KX514223
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaccaucgacggcgagcuccucggcaccacccagcucuccuccgucaacaucugcaccuuccgcggcgacgucacccacaucggcuccacccaccacuggaccaugaaccucgccucccccaacuggaacaacuacgaccccaccgaggagacccccgccccccucggcacccccgacuucgucggcaagauccacggcaugcucacccagaccacccagggcuccggcuccacccgcgcccaccgcgccaccgucuacgucggcuccgccgacuucacccccaagcucggcaagguccaguucgagaccgagaccgaccacgaccucgccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccgacgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17213 - RNA, 1614 nt, Artificial Sequence
  derived and/or modified sequence opt2 from VP1__Norovirus_and/or_Norovirus-like__KX514318
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccgucaaccucgagcgccucuucaccggccccuccuccgccaacgucguccagccccagaacggccgcugcaugaucgacggcguccuccucggcaccacccagcucucccccgucaacaucugcaccuuccgcggcgacgucacccaccccggcggcuccaagaucuacaccaugaaccucgccucccccaacuggaacaacuacgaccccaccgaggagauccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccgaggacgaccucgccauccgccagaacaccaaguucacccccgucggcgucauccaguccuccgaccaccaccgcgacgagccccagcaguggcgccuccccaacuacuccggccgcgacacccccaacguccaccucgcccccaccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucacccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17214 - RNA, 1614 nt, Artificial Sequence
  derived and/or modified sequence opt2 from VP1__Norovirus_and/or_Norovirus-like__AB186065
augaagauggccuccaacgacgucaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaaguccuucaccguccccguccucaccgucgaggagaugaccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcauccccgacuucgucggcaagauccagggccuccucacccagaccacccgcgccgacggcuccacccgcgcccacaaggccaccgucuccaccggcuccguccacuucacccccaagcucggcuccguccaguucuccaccgacaccgacaacgacuuccagcccggccagaacaccaaguucacccccgucggcgucauccaggacggcgaccgccaccagaacgagccccagcaguggguccuccccgacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaguccgcccccgcccaguccgacgucgcccuccuccgcuucgucaaccccgacaccaaccgcguccucuucgagugcaagcuccacaaguccggcuacaucaccgucgcccacaccggccagcacgaccucauccucccccccaacggcuacuuccgcuucgacuccugggucaaccaguucuacacccucgcccccaugggcaacggcgccggccgccgccgcuga

SEQ ID NO: 17215 - RNA, 1614 nt, Artificial Sequence
  derived and/or modified sequence opt2 from VP1__Norovirus_and/or_Norovirus-like__KX514307
augaagauggccuccuccgacgccaaccccuccgacggcuccaccgccaaccucguccccgaggucaacaacgaggucauggcccucgagcccgucgucggcgccgccaucgccgcccccgucgucggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcaccaagcccuucuccguccccauccucaccgucggcgagaugaccaacucccgcuuccccaucaaccucgagcgccucuucaccggccccuccuccgccaacgucguccagccccagaacggccgcugcaugaucgacggcguccuccucggcaccacccagcucucccccgucaacaucugcaccuuccgcggcgacgucacccaccccggcggcuccaagaucuacaccaugaaccucgccucccccaacuggaacaacuacgaccccaccgaggagacccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccgcuucgagaccgacaccggcgacgaccucgccauccgccagaacaccaaguucacccccgucggcgucauccaguccuccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccccggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17216 - RNA, 1614 nt, Artificial Sequence
  derived and/or modified sequence opt2 from VP1__Norovirus_and/or_Norovirus-like__LC048948
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagucccacgacuccacccucaagcucaucgccguccucuacaccccccuccgcaccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgagaccaccaugaaccucgccucccagaacugguccaacuacgaccccacccagaagauccccgccccccucggcaccccccacuucgucggcaagauccagggccuccucacccagaccacccgcgcccacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccacgaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuucgaccucggcaucccccccaacggcuacuuccgcuucgacuccugggucaaccaguucuacacccucgcccccaugggcaacggcaccggccgccgccgcuga

SEQ ID NO: 17217 - RNA, 1614 nt, Artificial Sequence
  derived and/or modified sequence opt2 from VP1__Norovirus_and/or_Norovirus-like__LC048908
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagucccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgacuacaccaugaaccucgccucccagaacugguccaacuacgaccccaccgaggagauccccgccccccucggcacccccgacuucgucggcaagauccagggccuccucacccagaccacccgcgcccacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggagaccgcccccgcccagcccgacgucgcccuccuccgcuucgucaaccccgacaccucccgcguccucugcgagugcaagcuccccaaguccggcuacaucaccgucgcccacaccggccccuacgaccucgucaucccccccaacggcuacuuccgcuucgacuccugggucaaccaguucuacacccucgcccccaugggcaacggcaccggccgccgccgcuga

SEQ ID NO: 17218 - RNA, 1614 nt, Artificial Sequence
  derived and/or modified sequence opt2 from VP1__Norovirus_and/or_Norovirus-like__KX514312
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaaccccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccaccccggcggcuccaagaucuacaccaugaaccucgccucccccaacuggaacaacuacgaccccaccgaggagauccccgccccccucggcacccccgacuucgucggcaagauccacggcaugcucacccagaccacccaggagaacggcuccacccgcgcccaccgcgccaccgucuacgucggcggcgccaacuucacccccaagcucggcaagguccaguucgagaccgacaccggcgacgaccucgccauccgccagaacaccaaguucacccccgucggcgucauccaguccuccgaccaccaccgcgacgagccccagcaguggcgccuccccaacuacuccggccgcgacacccccaacguccaccucgcccccgccgucgcccccaccuuccccggcgagcagcuccucuucuuccgcuccaccauccccggcugcggcggccaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcuga

SEQ ID NO: 17219 - RNA, 1614 nt, Artificial Sequence
  derived and/or modified sequence opt2 from VP1__Norovirus_and/or_Norovirus-like__KX514237
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgucggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcuccaagcccuucuccguccccguccucaccgucgaggagaugaccaacucccgcuuccccgccacccucgacaagcucuucaccggccccuccuccaccuucgucguccagccccagaacggccgcugcaugaucgacggcguccuccucggcaccacccagcucucccccgucaacaucugcaccuuccgcggcgacgucacccacccccgcgacucccccaucuacaccaugaaccucgccucccccaacuggaacaacuacgaccccaccgaggagauccccgccccccucggcacccccgacuucgucggcaagauccagggcaugcucacccagaccacccagggcuccggcuccacccgcgcccaccgcgccaccgucuacgucggcuccgccgacuucacccccaagcucggcaagguccaguucgagaccgagaccgaccacgaccucgccauccgccagaacaccaaguucacccccgucggcgucauccaggaguccgaccaccaccgcgacgagccccagcaguggcgccuccccaacuacuccggcgccaacaccuucaacguccaccucgcccccgccgucgcccccaacuuccccggcgagcagcuccucuucuuccgcuccacccuccucggcugcggcggccaccccaacauggaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccaguacgaccucguccuccccuccaacggcuacuuccgcuucgacuccugggucaaccaguucuacacccucgcccccaugggcaacggcaccggccgccgccgcuga

SEQ ID NO: 17220 - RNA, 1614 nt, Artificial Sequence
  derived and/or modified sequence opt2 from VP1__Norovirus_and/or_Norovirus-like__DQ419907
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacuccuccguccaggcccccggcggcgaguucaccgucuccccccgcgacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgccccccccaacuuccccaccgagggccucucccccucccaggucaccauguucccccacaucaucgucggcguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaacugcucccgcguccccgccgucccccucuccuccaaccacaagaugcagugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcuga

SEQ ID NO: 17221 - RNA, 1614 nt, Artificial Sequence
  derived and/or modified sequence opt2 from VP1__Norovirus_and/or_Norovirus-like__JN975543
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcaccgccuacguccccggcgaccgcgccgccccccucggcuaccccgacuucuccggccagcucgagaucgagguccagaccgagaccaccaaggccggcgacaagcucaaggucaccaccuucgagaugauccucggccccaccaccaacgucgaccaggcccccuaccagggccgcgucuacgccuccaucaccgccauggccucccucgaccucgucgacggccgcguccgcgccgucccccgcuccaucuacuccuuccaggacgucauccccgaguacaacgacggccuccucgucccccucgccccccccaucggccccuuccuccccggcgagguccuccuccgcuuccgcaccuacaugcgccagcucgacaccgccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcgcccucaccuuccccaccgacggcuucuucgaggucgucuccugggucccccgccucuaccagcucgccuccgucggcucccucgccaccggccgcuga

SEQ ID NO: 17222 - RNA, 1614 nt, Artificial Sequence
  derived and/or modified sequence opt2 from VP1__Norovirus_and/or_Norovirus-like__JN975541
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcaccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggccgcgucuacgccuccaucaccgccgccgccucccucgaccucgucgacggccgcguccgcgccgucccccgcuccaucuacuccuuccaggacgccauccccgaguacaacgacggccuccucgucccccucgccccccccaucggccccuuccuccccggcgagguccuccuccgcuuccgcaccuacaugcgccagcucgacaccgccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcgcccucaccuuccccaccgacggcuucuucgaggucgucuccugggucccccgccucuaccagcucgccuccgucggcucccucgccaccggccgcuga

SEQ ID NO: 17223 - RNA, 1614 nt, Artificial Sequence
  derived and/or modified sequence opt2 from VP1__Norovirus_and/or_Norovirus-like__KF113526
augcgcauguccgacggcgccgcccccaaggccaacggcuccgaggccuccggccaggaccucguccccaccgccgucgagcaggccguccccauccagcccgucgccggcgccucccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccgccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaaggccggcgacaagcucaaggucaccaccuucgagaugauccucggccccaccaccaacgucgaccaggcccccuaccagggccgcgucuacgccucccucaccgccgccgccucccucgaccucgucgacggccgcguccgcgccgucccccgcuccaucuacggcuuccaggaccagauccccgaguacaacgacggccuccucgucccccucgccccccccgucggccccuuccuccccggcgagcuccuccuccgcuuccgcaccuacaugcgccagaucgacuccgccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcuga

SEQ ID NO: 17224 - RNA, 1614 nt, Artificial Sequence
  derived and/or modified sequence opt2 from VP1__Norovirus_and/or_Norovirus-like__KF113527
augcgcauguccgacggcgccgcccccaaggccaacggcuccgaggccuccggccaggaccucguccccaccgccgucgagcaggccguccccauccagcccgucgccggcgccucccucgccgcccccgccgccggccagaucaaccagaucgaccccuggaucuuccagaacuucguccagugcccccucggcgaguucuccaucuccccccgcaacgcccccggcgagauccucuucgaccucgcccucggccccggccucaaccccuaccucgcccaccucuccgccauguacaccggcugggucggcaacauggagguccagcucguccucgccggcaacgccuucaccgccuccaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaaggccggcgacaagcucaaggucaccaccuucgagaugauccucggccccaccaccaacgucgaccaggcccccuaccagggccgcgucuacgccucccucaccgccgccgccucccucgaccucgucgacggccgcguccgcgccgucccccgcuccaucuacggcuuccaggaccagauccccgaguacaacgacggccuccucgucccccucgccccccccgucggccccuuccuccccggcgagcuccuccuccgcuuccgcaccuacaugcgccagaucgacuccgccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcuga

SEQ ID NO: 17225 - RNA, 1614 nt, Artificial Sequence
  derived and/or modified sequence opt2 from VP1__Norovirus_and/or_Norovirus-like__KM458057
augcgcauguccgacggcgccgcccccaaggccgacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggccaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggcaaggucuucgccuccaucaccgccgccgccucccucgaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccagcucgacaccgccgacgccgccgccgaggccaucgacugcgcccucccccaggaguucaucuccugguucgccuccaacgucuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcuga

SEQ ID NO: 17226 - RNA, 1614 nt, Artificial Sequence
  derived and/or modified sequence opt2 from VP1__Norovirus_and/or_Norovirus-like__AB662855
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucucccucgagcucggccccgagcucaaccccuaccucgcccaccucgcccgcauguacaacggccacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacguccccgccccccucggcguccccgacuuccagggccgcgucuucggcgucaucucccagcgcgacaagcagaacgccgccggccacaacgagcccgccaaccgcggccacgacgccgucguccccaccuacaccgcccaguacacccccaagcucggccagguccagaucggcaccuggcagaccgacgaccuccaggucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggcuga

SEQ ID NO: 17227 - RNA, 1614 nt, Artificial Sequence
  derived and/or modified sequence opt2 from VP1__Norovirus_and/or_Norovirus-like__AB809997
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgagcgcgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggcuga

SEQ ID NO: 17228 - RNA, 1614 nt, Artificial Sequence
  derived and/or modified sequence opt2 from VP1__Norovirus_and/or_Norovirus-like__AB810001
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggcuga

SEQ ID NO: 17229 - RNA, 1614 nt, Artificial Sequence
  derived and/or modified sequence opt2 from VP1__Norovirus_and/or_Norovirus-like__AB809992
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucgaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggcuga

SEQ ID NO: 17230 - RNA, 1611 nt, Artificial Sequence
  derived and/or modified sequence opt2 from VP1__Norovirus_and/or_Norovirus-like__AY130761
augaagauggccuccaacgacgccacccccuccgacgacggcgccgccggccucguccccgagaucaacaacgaggucauggcccucgagcccgucgccggcgccuccaucgccgcccccgucgucggccagcagaacaucaucgaccccuggauccgcaacaacuucguccaggcccccgccggcgaguucaccgucuccccccgcaacucccccggcgagcuccuccucgaccucgagcucggccccgagcucaaccccuaccucgcccaccucgcccgcauguacaacggccacgccggcggcauggagguccagaucguccucgccggcaacgccuucaccgccggcaagauccucuucgccgccaucccccccuccuuccccuacgagaaccucucccccgcccagcucaccaugugcccccacgucaucgucgacguccgccagcucgagcccguccuccuccccaugcccgacauccgcaacgucuucuaccacuacaaccagaacaacucccccaagcuccgccucgucgccaugcucuacaccccccuccgcgccaacaacuccggcgacgacgucuucaccgucuccugccgcguccucacccgccccucccccgacuuccaguucaccuuccucgucccccccaccgucgaguccaagaccaagaacuucacccuccccguccuccgcgucuccgagaugaccaacucccgcuuccccgucguccucgaccagauguacaccucccgcaacgagaacaucaucguccagccccagaacggccgcugcaccaccgacggcgagcuccucggcaccaccacccuccaguccgucuccaucugcaacuuccgcggcaccaugcaggccaagcucaacgagcagccccgcuaccagcuccagcucaccaaccucgacggcucccccaucgaccccaccgacgacaugcccgccccccucggcacccccgacuuccaggccaugcucuacggcgucgccucccagcgcuccucccgcgacaacgccacccgcgcccacgacgcccagaucgacaccgccggcgacaccuucgcccccaagaucggccagguccgcuucaaguccuccuccgacgacuucgaccuccacgaccccaccaaguucacccccaucggcgucaacgucgacgaccagcaccccuuccgccaguggucccuccccaacuacggcggccaccucgcccucaacaaccaccucgcccccgccgucaccccccucuuccccggcgagcagauccucuucuuccgcucccacauccccuccgccggcggccacaccgacggcgccaucgacugccuccucccccaggaguggaucgagcacuucuaccaggaggccgcccccucccaguccgacaucgcccucguccgcuucaucaaccccgacaccggccgcguccuccucgaggccaagcuccacaagcagggcuuccucaccgucgccgccuccggcgaccaccccaucgucaugcccaccaacggcuacuuccgcuucgaggccugggucaaccccuucuacacccucgcccccgucggcaccggcuccggccgccgccgcauccaguga

SEQ ID NO: 17231 - RNA, 1611 nt, Artificial Sequence
  derived and/or modified sequence opt2 from VP1__Norovirus_and/or_Norovirus-like__KF806495
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucuccgacaagaccuucgccaugaaccucgccucccccaacuggaacaacuacgaccccaccgaggacauccccgccccccucggcacccccgacuucgucggccgcauccacggcaugcucacccagaccacccgccgcgacggcgccacccgcggccacaaggccaccgucuccaccggcggcgccgacuucacccccaagcucggcuccguccgcuacaucaccgacaccaccgacgaccucgagguccgcgagaacaccaaguucacccccaucggcguccuccacuccuccggcgagcaccgcgccgagcccgaccaguggcgccuccccgaguacuccggccgcaacguccacaacguccaccucgcccccgccgucgcccccaccuuccccggcgagcagcuccucuucuuccgcuccgcccuccccggcugcggcggcuaccccaacaccgaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 17232 - RNA, 1611 nt, Artificial Sequence
  derived and/or modified sequence opt2 from VP1__Norovirus_and/or_Norovirus-like__KF806503
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaucaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgacgagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucuccgacaagaccuucgccaugaaccucgccucccccaacuggaacaacuacgaccccaccgaggagauccccgccccccucggcacccccgacuucgucggccgcauccacggcaugcucacccagaccacccgccgcgacggcgccacccgcggccacaaggccaccgucuccaccggcggcgccgacuucacccccaagcucggcuccguccgcuacaucaccgacaccaccgacgaccucgagguccgcgagaacaccaaguucacccccaucggcguccuccacuccuccggcgagcaccgcgccgagcccgaccaguggcgccuccccgaguacuccggccgcaacguccacaacguccaccucgcccccgccgucgcccccaccuuccccggcgagcagcuccucuucuuccgcuccgcccuccccggcugcggcggcuaccccaacaccgaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 17233 - RNA, 1611 nt, Artificial Sequence
  derived and/or modified sequence opt2 from VP1__Norovirus_and/or_Norovirus-like__KF712506
augaagauggccuccuccgacgccaaccccuccgacggcuccaccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagguccucugguccgccccccucggccccgaccucaaccccuaccucucccaccucgcccgcauguacaacggcuacgccggcggcuucgagguccaggucauccucgccggcaacgccuucgccgccggcaagaucaucuucgccgccgucccccccaacuucuccaccgagggccucucccccucccaggucaccauguucccccaccucaucgucgacguccgccagcucgagcccgucaugaucccccuccccgacauccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgaguccaagaccaaccccuucuccguccccauccucaccaucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaccaccaagacccacaccuaccagaugaaccucgccgcccagaacuggaacuccuacgaccccaccgaggagauccccgccccccucggcacccccgacuucgucggcaagauccagggcguccucacccagaccaccaaggagaacggcuccacccgcgcccacaaggccaccgucuacaccggcaccgucgaguucacccccaagcucggccgcauccagcucuucaccgacaccgacaacgaccucgaggccaaccagaacaccaaguucacccccgucggcgucauccaggacggcgaccaccagaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaccacgaccucgucaucccccccaacggcuacuuccgcuucgacuccugggucucccccuucuacacccucgcccccaugggcaacggcaccggccgccgccgcuga

SEQ ID NO: 17234 - RNA, 1611 nt, Artificial Sequence
  derived and/or modified sequence opt2 from VP1__Norovirus_and/or_Norovirus-like__KF712507
augaagauggccuccuccgacgccaaccccuccgacggcuccaccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagguccucugguccgccccccucggccccgaccucaaccccuaccucucccaccucgcccgcauguacaacggcuacgccggcggcuucgagguccaggucauccucgccggcaacgccuucgccgccggcaagaucaucuucgccgccgucccccccaacuucuccaccgagggccucucccccucccaggucaccauguucccccaccucaucgucgacguccgccagcucgagcccgucaugaucccccuccccgacauccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgaguccaagaccaaccccuucuccguccccauccucaccaucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaccaccaagacccacaccuaccagaugaaccucgccgcccagaacuggaacuccuacgaccccaccgaggagauccccgccccccucggcacccccgacuucgucggcaagauccagggcguccucacccagaccaccaagggcaacggcuccacccgcgcccacaaggccaccgucuacaccggcaccgucgaguucacccccaagcucggccgcauccagcucuucaccgacaccgacaacgaccucgaggccaaccagaacaccaaguucacccccgucggcgucauccaggacggcgaccaccagaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaccacgaccucgucaucccccccaacggcuacuuccgcuucgacuccugggucucccccuucuacacccucgcccccaugggcaacggcaccggccgccgccgcuga

SEQ ID NO: 17235 - RNA, 1611 nt, Artificial Sequence
  derived and/or modified sequence opt2 from VP1__Norovirus_and/or_Norovirus-like__JX401281
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccaugccccucucccccgagcucaaccccuaccucucccaccucucccgcauguacaacggcuacgccggcggcuucgagguccaggucauccucgccggcaacgccuucaccgccggcaagaucaucuucgccgccaucccccccaacuuccccaccgacggccucucccccucccaggucaccauguucccccacaucaucgucgacguccgccagcucgagcccguccucaucccccuccccgacguccgcaacaacuucuaccacuacaaccaggccaacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgacgagaugaccaacucccgcuuccccaccccccucgagaagcuccacaccggccccaacaacuccaucgucguccagccccagaacggccgcugcaccaucgacggcguccuccucggcaccacccagcucuccaccgucaacaucugcaacuuccgcggcuccaccacccgcgccggccagucccacgccuacaccaugaaccucgucucccagaacuggaacaacuacgaccccaccgaggagauccccgccccccucggcacccccgacuucgucggcaagaucgucggcaugcucucccagaccacccgcgagaacuccuccacccgcgcccacaaggccaccgucuccaccggcgacgcccacuucacccccaaguccggcuccguccucuucaccaccgacaccgacgaccuccagaacggccagaacacccgcuucacccccgucggcgucgcccaggacggcgagccccaccagaacgagccccagcaguggcgccuccccaacuacuccggcacccccggccacaacguccaccucgccccccccgucgcccccaccuuccccggcgagcagcuccucuucuuccgcuccaccaugcccggcugcggcggcuaccccaacauggaccucgacugccuccucccccaggaguggguccgccacuucuaccaggaggccgcccccgcccaguccgacgucgcccuccuccgcuucgucaaccccgacaccggccgcguccucuucgagugcaagcuccacaaggccggcuacaucaccgucucccacaccggccccuacgaccucgucaucccccccaacggcuacuuccgcuucgacuccugggucaaccaguucuacgcccucgcccccaugggcaccggcaccggccgccgccgcuga

SEQ ID NO: 17236 - RNA, 1611 nt, Artificial Sequence
  derived and/or modified sequence opt2 from VP1__Norovirus_and/or_Norovirus-like__KF806526
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaaguucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucgccggcacccacgaguacgccaugaaccucgccucccagaacuggaacaacuacgaccccaccgaggagauccccgccccccucggcgcccccgacuucgucggcaagauccgcggcguccucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgcuga

SEQ ID NO: 17237 - RNA, 1611 nt, Artificial Sequence
  derived and/or modified sequence opt2 from VP1__Norovirus_and/or_Norovirus-like__KF806500
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucgccggcgacaccuucgccaugaaccucgccucccucaacuggaacaacuacgaccccaccgaggagacccccgccccccucggcacccccgacuucgucggccgcauccacggcaugcucacccagaccacccgcuccgacggcgccacccgcgcccacaaggccaccgucuccaccggcggcgccgacuucacccccaagcucggcuccguccgcuacuccaccgacaccuccuccgaccucgagguccgcgagaacaccaaguucacccccaucggcguccuccacuccuccggcggccaccgcgccgagcccgaccaguggcgccuccccgaguacuccggccgcaacguccacaacguccaccucgcccccgccgucgcccccaccuuccccggcgagcagcuccucuucuuccgcuccaccaugcccggcugcggcggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 17238 - RNA, 1611 nt, Artificial Sequence
  derived and/or modified sequence opt2 from VP1__Norovirus_and/or_Norovirus-like__KF806498
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucgccggcgacaccuucgccaugaaccucgccucccucaacuggaacaacuacgaccccaccgaggagacccccgccccccucggcacccccgacuucgucggccgcauccacggcaugcucacccagaccacccgcuccgacggcgccacccgcgcccacaaggccaccgucuccaccggcggcgccgacuucacccccaagcucggcuccguccgcuacuccaccgacaccuccuccgaccucgagguccgcgagaacaccaaguucacccccaucggcguccuccacuccuccggcggccaccgcgccgagcccgaccaguggcgccuccccgaguacuccggccgcaacguccacaacguccaccucgcccccgccgucgcccccaccuuccccggcgagcagcuccucuucuuccgcuccaccaugcccggcugcggcggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 17239 - RNA, 1611 nt, Artificial Sequence
  derived and/or modified sequence opt2 from VP1__Norovirus_and/or_Norovirus-like__KF429768
augaagauggccuccuccgacgccaaccccuccgacggcuccaccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagguccucugguccgccccccucggccccgaccucaaccccuaccucucccaccucgcccgcauguacaacggcuacgccggcggcuucgagguccaggucauccucgccggcaacgccuucgccgccggcaagaucaucuucgccgccgucccccccaacuucuccaccgagggccucucccccucccaggucaccauguucccccaccucaucgucgacguccgccagcucgagcccgucaugaucccccuccccgacauccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgaguccaagaccaaccccuucuccguccccauccucaccaucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaccaccaagacccacaccuaccagaugaaccucgccgcccagaacuggaacuccuacgaccccaccgaggagacccccgccccccucggcacccccgacuucgucggcaagauccagggcguccucacccagaccaccaagggcaacggcuccacccgcgcccacaaggccaccgucuacaccggcaccgucgaguucacccccaagcucggccgcauccagcucuucaccgacaccgacaacgaccucgaggccaaccagaacaccaaguucacccccgucggcgucauccaggacggcgaccaccagaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaccacgaccucgucaucccccccaacggcuacuuccgcuucgacuccugggucucccccuucuacacccucgcccccaugggcaacggcaccggccgccgccgcuga

SEQ ID NO: 17240 - RNA, 1611 nt, Artificial Sequence
  derived and/or modified sequence opt2 from VP1__Norovirus_and/or_Norovirus-like__KF806496
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucgccggcgacaccuucgccaugaaccucgccucccucaacuggaacaacuacgaccccaccgaggagacccccgccccccucggcacccccgacuucgucggccgcauccacggcaugcucacccagaccacccgcuccgacggcgccacccgcgcccacaaggccaccgucuccaccggcggcgccgacuucacccccaagcucggcuccguccgcuacuccaccgacaccuccggcgaccucgagguccgcgagaacaccaaguucacccccaucggcguccuccacuccuccggcgagcgccgcgccgagcccgagcaguggcgccuccccgaguacuccggccgcaacguccacaacguccaccucgcccccgccgucgcccccaccuuccccggcgagcagcuccucuucuuccgcuccaccaugcccggcugcggcggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 17241 - RNA, 1611 nt, Artificial Sequence
  derived and/or modified sequence opt2 from VP1__Norovirus_and/or_Norovirus-like__KF806499
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucgccggcgacaccuucgccaugaaccucgccucccucaacuggaacaacuacgaccccaccgaggagacccccgccccccucggcacccccgacuucgucggccgcauccacggcaugcucacccagaccacccgcuccgacggcgccacccgcgcccacaaggccaccgucuccaccggcggcgccgacuucacccccaagcucggcuccguccgcuacuccaccgacaccuccuccgaccucgagguccgcgagaacaccaaguucacccccaucggcguccuccacuccuccggcggccaccgcgccgagcccgaccaguggcgccuccccgaguacuccggccgcaacguccacaacguccaccucgcccccgccgucgcccccaccuuccccggcgagcagcuccucuucuuccgcuccaccaugcccggcugcggcggcuaccccaacauggaccucgacugccuccucccccaggaguggguccagcacuucuaccaggagaccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 17242 - RNA, 1611 nt, Artificial Sequence
  derived and/or modified sequence opt2 from VP1__Norovirus_and/or_Norovirus-like__KF806497
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucgccggcgacaccuucgccaugaaccucgccucccucaacuggaacaacuacgaccccaccgaggagacccccgccccccucggcacccccgacuucgucggccgcauccacggcaugcucacccagaccacccgcuccgacggcgccacccgcgcccacaaggccaccgucuccaccggcggcgccgacuucacccccaagcucggcuccguccgcuacuccaccgacaccuccuccgaccucgagguccgcgagaacaccaaguucacccccaucggcguccuccacuccuccggcggccaccgcgccgagcccgaccaguggcgccuccccgaguacuccggccgcaacguccacaacguccaccucgcccccgccgucgcccccaccuuccccggcgagcagcuccucuucuuccgcuccaccaugcccggcugcggcggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcuga

SEQ ID NO: 17243 - RNA, 1611 nt, Artificial Sequence
  derived and/or modified sequence opt2 from VP1__Norovirus_and/or_Norovirus-like__JN699046
augaugauggccuccaaggacgccucccccuccgccgacggcgccaacggcgccggccagcucguccccgaggucaacaacgccgagccccucccccucgaccccgucgccggcgccuccaccgcccucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcgucauccucgccggcaacgccuucaccgccggcaaggucaucaucugcugcgucccccccggcuuccagucccgcacccucuccaucgcccaggccacccucuucccccacaucaucgccgacguccgcacccucgagcccaucgagaucccccucgaggacguccgcaacacccucuaccacaccaacgacaaccagcccaccaugcgccuccucugcaugcucuacaccccccuccgcaccggcggcggcuccggcggcaccgacgccuucgucgucgccggccgcguccucaccugccccuccuccgacuucaacuuccucuuccucgucccccccaccgucgagcagaagacccgccccuucuccguccccaacaucccccuccagcuccucuccaacucccgcguccccaaccucauccaguccaugguccucucccccgaccaggcccagaacguccaguuccagaacggccgcugcaccaccgacggccagcuccucggcaccacccccgucuccgucucccagauccucaaguuccgcggcaaggucuccgccggcucccgcgucaucaaccucaccgagcucgacggcucccccuuccucgccuucgaggcccccgcccccaccggcuuccccgaccucggcaccuccgacuggcacgucgagaugucccucaacuccaacucccaguccuccggcaaccccauccuccuccgcgacauccagcccaacuccuccgacuucgucccccaccucggcuccgucuccgucaccaccgccaucgacgucgccggcgacuacaccggcaccauccaguggaccucccagcccuccaacgucacccccguccccgacgucaacuucuggaccaucccccaguacggcuccaaccucgccgaggccucccagcucgcccccgucgucuacccccccggcuucggcgaggccaucgucuacuucaugucccccauccccggccccaacaccgcccacaagcccaaccucguccccugccuccucccccaggaguucgucacccacuucgucuccgagcaggcccccuccaugggcgaggccgcccucguccacuacgucgaccccgacaccaaccgcaaccucggcgaguucaagcucuaccccgagggcuucaucaccugcguccccaacggcaccggcccccagcagcucccccucaacggcgucuucgucuucgccuccugggucucccgcuucuaccagcucaagcccgucggcaccgccuccuccgcccgcuga

SEQ ID NO: 17244 - RNA, 1611 nt, Artificial Sequence
  derived and/or modified sequence opt2 from VP1__Norovirus_and/or_Norovirus-like__AM263418
augaugauggccuccaaggacgccucccccuccgccgacggcgccaacggcgccggccagcucguccccgaggucaacaacgccgagccccucccccucgaccccgucgccggcgccuccaccgcccucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcgucauccucgccggcaacgccuucaccgccggcaaggucaucgucugcugcgucccccccggcuuccagucccgcacccucuccaucgcccaggccacccucuucccccacaucaucgccgacguccgcacccucgagcccaucgagaucccccucgaggacguccgcaacacccucuaccacaccaacgacaaccagcccaccaugcgccuccucugcaugcucuacaccccccuccgcaccggcggcggcuccggcggcaccgacgccuucgucgucgccggccgcguccucaccugccccuccuccgacuucaacuuccucuuccucgucccccccaccgucgagcagaagacccgccccuucuccguccccaacaucccccuccagcuccucuccaacucccgcguccccaaccucauccaguccaugguccucucccccgaccaggcccagaacguccaguuccagaacggccgcugcaccaccgacggccagcuccucggcaccacccccgucuccgucucccagauccucaaguuccgcggcaaggucuccgccggcucccgcgucaucaaccucaccgagcucgacggcucccccuuccucgccuucgaggcccccgcccccaccggcuuccccgaccucggcaccuccgacuggcacgucgagaugucccucaacuccaacucccaguccuccggcaaccccauccuccuccgcgacauccagcccaacuccuccgacuucgucccccaccucggcuccgucgccgucaccaccgccaucgacgucgccggcgacuacaccggcaccauccaguggaccucccagcccuccaacgucacccccguccccgacgucaacuucuggaccaucccccaguacggcuccaaccucgccgaggccucccagcucgcccccgucgucuacccccccggcuucggcgaggccaucgucuacuucaugucccccauccccggccccaacaccgcccacaagcccaaccucguccccugccuccucccccaggaguucgucacccacuucgucuccgagcaggcccccuccaugggcgaggccgcccucguccacuacgucgaccccgacaccaaccgcaaccucggcgaguucaagcucuaccccgagggcuucaucaccugcguccccaacggcaccggcccccagcagcucccccucaacggcgucuucgucuucgccuccugggucucccgcuucuaccagcucaagcccgucggcaccgccuccuccgcccgcuga

SEQ ID NO: 17245 - RNA, 1611 nt, Artificial Sequence
  derived and/or modified sequence opt2 from VP1__Norovirus_and/or_Norovirus-like__KT732278
augaugauggccuccaaggacgccacccccuccgccgacggcgccaacggcgccggccagcucguccccgaggucaacaacgccgagccccucccccucgaccccgucgccggcgccuccaccgcccucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcgucauccucgccggcaacgccuucaccgccggcaaggucaucaucugcugcgucccccccggcuuccagucccgcacccucuccaucgcccaggccacccucuucccccacaucaucgccgacguccgcacccucgagcccaucgagaucccccucgaggacguccgcaacacccucuaccacaccaacgacaaccagcccaccaugcgccuccucugcaugcucuacaccccccuccgcaccggcggcggcuccggcggcaccgacgccuucgucgucgccggccgcguccucaccucccccucccccgacuucaacuuccucuuccucgucccccccaccgucgagcagaagacccgccccuucuccguccccaacaucccccuccagcuccucuccaacucccgcguccccaaccucauccaguccaugguccucucccccgaccaggcccagaacguccaguuccagaacggccgcugcaccaccgacggccagcuccucggcaccacccccgucuccgucucccagauccucaaguuccgcggcaaggucuccgccggcuccaaggucaucaaccucaccgagcucgacggcucccccuuccucgccuucgaggcccccgcccccaccggcuuccccgaccucggcaccuccgacuggcacaucgagaugucccucaacuccaacucccaguccuccggcaaccccauccuccuccgcgacauccagcccaacuccuccgacuucgucccccaccucggcuccgucgccgucaccaccgccaucgacaccgccggcgacuacaccggcaccauccaguggaccucccagcccuccaacgucacccccguccccgacgucaacuucuggaccaucccccaguacggcuccaaccucgccgaggccucccagcucgcccccgucgucuacccccccggcuucggcgaggccaucgucuacuucaugucccccauccccggccccaacaccgcccacaagcccaaccucguccccugccuccucccccaggaguucgucacccacuucgucuccgagcaggcccccuccaugggcgaggccgcccucguccacuacgucgaccccgacaccaaccgcaaccucggcgaguucaagcucuaccccgagggcuucaucaccugcguccccaacggcaccggcccccagcagcucccccucaacggcgucuucgucuucgccuccugggucucccgcuucuaccagcucaagcccgucggcaccgccaacuccgcccgcuga

SEQ ID NO: 17246 - RNA, 1611 nt, Artificial Sequence
  derived and/or modified sequence opt2 from VP1__Norovirus_and/or_Norovirus-like__KT732277
augaugauggccuccaaggacgccacccccuccgccgacggcgccaacggcgccggccagcucguccccgaggucaacaacgccgagccccucccccucgaccccgucgccggcgccuccaccgcccucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcgucauccucgccggcaacgccuucaccgccggcaaggucaucaucugcugcgucccccccggcuuccagucccgcacccucuccaucgcccaggccacccucuucccccacaucaucgccgacguccgcacccucgagcccaucgagaucccccucgaggacguccgcaacacccucuaccacaccaacgacaaccagcccaccaugcgccuccucugcaugcucuacaccccccuccgcaccggcggcggcuccggcggcaccgacgccuucgucgucgccggccgcguccucaccucccccucccccgacuucaacuuccucuuccucgucccccccaccgucgagcagaagacccgccccuucuccguccccaacaucccccuccagcuccucuccaacucccgcguccccaaccucauccaguccaugguccccucccccgaccaggcccagaacguccaguuccagaacggccgcugcaccaccgacggccagcuccucggcaccacccccgucuccgucucccagauccucaaguuccgcggcaaggucuccgccggcuccaaggucaucaaccucaccgagcucgacggcucccccuuccucgccuucgaggcccccgcccccaccggcuuccccgaccucggcaccuccgacuggcacaucgagaugucccucaacuccaacucccaguccuccggcaaccccauccuccuccgcgacauccagcccaacuccuccgacuucgucccccaccucggcuccgucgccgucaccaccgccaucgacaccgccggcgacuacaccggcaccauccaguggaccucccagcccuccaacgucacccccguccccgacgucaacuucuggaccaucccccaguacggcuccaaccucgccgaggccucccagcucgcccccgucgucuacccccccggcuucggcgaggccaucgucuacuucaugucccccauccccggccccaacaccgcccacaagcccaaccucguccccugccuccucccccaggaguucgucacccacuucgucuccgagcaggcccccuccaugggcgaggccgcccucguccacuacgucgaccccgacaccaaccgcaaccucggcgaguucaagcucuaccccgagggcuucaucaccugcguccccaacggcaccggcccccagcagcucccccucaacggcgucuucgucuucgccuccugggucucccgcuucuaccagcucaagcccgucggcaccgccaacuccgcccgcuga

SEQ ID NO: 17247 - RNA, 1611 nt, Artificial Sequence
  derived and/or modified sequence opt2 from VP1__Norovirus_and/or_Norovirus-like__KJ402295
augaugauggccuccaaggacgcccccuccuccgccgacggcgccaacggcgccggccagcucguccccgaggucaacaacgccgagccccucccccucgaccccgucgccggcgccuccaccgcccucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcgucauccucgccggcaacgccuucaccgccggcaaggucaucaucugcugcgucccccccggcuuccagucccgcacccucuccaucgcccaggccacccucuucccccacaucaucgccgacguccgcacccucgagcccaucgagaucccccucgaggacguccgcaacacccucuaccacaccaacgacaaccagcccaccaugcgccuccucugcaugcucuacaccccccuccgcaccggcggcggcuccggcggcaccgacgccuucgucgucgccggccgcguccucaccugccccuccuccgacuucaacuuccucuuccucgucccccccaccgucgagcagaagacccgccccuucuccguccccaacaucccccuccagcuccucuccaacucccgcguccccaaccucauccaguccaugguccucucccccgaccaggcccagaacguccaguuccagaacggccgcugcaccaccgacggccagcuccucggcaccacccccgucuccgucucccagauccucaaguuccgcggcaaggucuccgccggcuccaaggucaucaaccucaccgagcucgacggcucccccuuccucgccuucgaggcccccgcccccaccggcuuccccgaccucggcaccuccgacuggcacgucgagaugucccucaacuccaacucccaguccuccggcaaccccauccuccuccgcgacauccaccccaacuccuccgaguucgucccccaccucggcuccgucugcgucaccgccgccaucgaggucgccggcgacuacaccggcaccauccaguggaccucccagcccuccaacgucacccccguccccgacgucaacuucuggaccaucccccacuacggcuccaaccucgccgaggccucccagcucgcccccgucgucuacccccccggcuucggcgaggccaucgucuacuucaugucccccauccccggccccaacaccgcccacaagcccaaccucguccccugccuccucccccaggaguucgucacccacuucgucuccgagcaggcccccuccaugggcgaggccgcccucguccacuacgucgaccccgacaccaaccgcaaccucggcgaguucaagcucuaccccgagggcuucaucaccugcguccccaacggcaccggcccccagcagcucccccucaacggcgucuucgucuucgccuccugggucucccgcuucuaccagcucaagcccgucggcaccgccuccuccgcccgcuga

SEQ ID NO: 17248 - RNA, 1611 nt, Artificial Sequence
  derived and/or modified sequence opt2 from VP1__Norovirus_and/or_Norovirus-like__AF414406
augaugauggccuccaaggacgccucccccuccgccgacggcgccaacggcgccggccagcucguccccgaggucaacaacgccgagccccucccccucgaccccgucgccggcgccuccaccgcccucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcgucauccucgccggcaacgccuucaccgccggcaaggucaucgucugcugcgucccccccggcuuccagucccgcacccucuccaucgcccaggccacccucuucccccacaucaucgccgacguccgcacccucgagcccaucgagaucccccucgaggacguccgcaacacccucuaccacaccaacgacaaccagcccaccaugcgccuccucugcaugcucuacaccccccuccgcaccggcggcggcuccggcggcaccgacgccuucgucgucgccggccgcguccucaccugccccuccuccgacuucaacuuccucuuccucgucccccccaccgucgagcagaagacccgccccuucuccguccccaacaucccccuccagcuccucuccaacucccgcguccccaaccucauccaguccaugguccccucccccgaccaggcccagaacguccaguuccagaacggccgcugcaccaccgacggccagcuccucggcaccacccccgucuccgucucccagauccucaaguuccgcggcaaggucuccgccggcucccgcgucaucaaccucaccgagcucgacggcucccccuuccucgccuucgaggcccccgcccccaccggcuuccccgaccucggcaccuccgacuggcacgucgagaugucccucaacuccaacucccaguccuccggcaaccccauccuccuccgcgacauccagcccaacuccuccgacuucgucccccaccucggcuccgucgccgucaccaccgccaucgacgucgccggcgacuacaccggcaccauccaguggaccucccagcccuccaacgucacccccguccccgacgucaacuucuggaccaucccccaguacggcuccaaccucgccgaggccucccagcucgcccccgucgucuacccccccggcuucggcgaggccaucgucuacuucaugucccccauccccggccccaacaccgcccacaagcccaaccucgucccccgccuccucccccaggaguucgucacccacuucgucuccgagcaggcccccuccaugggcgaggccgcccucguccacuacgucgaccccgacaccaaccgcaaccucggcgaguucaagcucuaccccgagggcuucgucaccugcaugcccaacggcaccggcccccagcagcucccccucaacggcgucuucgucuucgccuccugggucucccgcuucuaccagcucaagcccgucggcaccgccuccuccgcccgcuga

SEQ ID NO: 17249 - RNA, 1611 nt, Artificial Sequence
  derived and/or modified sequence opt2 from VP1__Norovirus_and/or_Norovirus-like__AB039774
augaugauggccuccaaggacgccacccccuccgccgacggcgccaacggcgccggccagcucguccccgaggucaacaacgccgagccccucccccucgaccccgucgccggcgccuccaccgcccucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcgucauccucgccggcaacgccuucaccgccggcaaggucaucaucugcugcgucccccccggcuuccagucccgcacccucuccaucgcccaggccacccucuucccccacgucaucgccgacguccgcacccucgagccccucgagaucccccucgaggacguccgcaacacccucuaccacaacaacgacucccagcccaccaugcgccuccucugcaugcucuacaccccccuccgcaccggcggcggcuccggcggcaccgacgccuucgucgucgccggccgcguccucaccugccccucccccgacuucaacuuccucuuccucgucccccccaccgucgagcagaagacccgccccuucuccguccccaacaucccccuccagaaccucuccaacucccgcguccccucccucauccaguccaugguccucuccaacgaccacgcccagaccguccaguuccagaacggccgcugcaccaccgacggccaccuccucggcaccacccccgucuccgccggccagcucaugaaguuccgcggcaaggucaccuccggcuccaagguccucaaccucaccgagcucgacggcucccccuuccucgccuucgaggcccccgcccccgccggcuuccccgaccucggcaagugcgacuggcacgucgagaugucccucuaccaggacaacaaccacgccgaccccaucguccuccacgccaucgagcccaacuccuccuccuucgucccccaccucggcuccgucuccuucaaggagaacgucaacgucgccggcgacuacgucugcaccauccaguacaccuccccccccuccgacccccacaaccccaacgccgacgucgacuucugguccauccccgacuacggcuccaaccucgccgaggccucccagcucgcccccgucgucuacccccccggcuucggcgaggccaucgucuacuucaugucccgcguccccggcuggaaccgcaccaaccgccucaaccucguccccugccuccucccccaggaguucaucggccacuucgucuccgagcaggcccccgccaucggcgaggccgcccuccuccacuacgucgaccccgacaccaaccgcaaccucggcgaguucaagcucuaccccgagggcuucaucaccugcguccccaacggcaccggcccccagcagcucccccucaacggcgucuucgucuucuccuccugggucucccgcuucuaccagcucaagcccgucggcaccgccucccucgcccgcuga

SEQ ID NO: 17250 - RNA, 1611 nt, Artificial Sequence
  derived and/or modified sequence opt2 from VP1__Norovirus_and/or_Norovirus-like__KP064095
auggccuccaaggacgccccccaguccgccgacggcgccuccggcgccggccagcucguccccgaggucaacaccgccgacccccuccccauggagcccgucgccggccccaccaccgccgucgccaccgccggccaggucaacaugaucgaccccuggaucgucaacaacuucguccaguccccccagggcgaguucaccaucucccccaacaacacccccggcgacauccucuucgaccuccagcucggcccccaccucaaccccuuccucucccaccucucccagauguacaacggcugggucggcaacaugcgcguccgcauccuccucgccggcaacgccuucuccgccggcaagaucaucgucugcugcgucccccccggcuucaccuccuccucccucaccaucgcccaggccacccucuucccccacgucaucgccgacguccgcacccucgagcccaucgagaugccccucgaggacguccgcaacguccucuaccacaccaacgacaaccagcccaccaugcgccucgucugcaugcucuacaccccccuccgcaccggcggcggcuccggcaacuccgacuccuucgucgucgccggccgcguccucaccgcccccuccuccgacuucuccuuccucuuccucgucccccccaccaucgagcagaagacccgcgccuucaccguccccaacaucccccuccagacccucuccaacucccgcuuccccucccucauccagggcaugauccucucccccgacgccucccaggucguccaguuccagaacggccgcugccucaucgacggccagcuccucggcaccacccccgccaccuccggccagcucuuccgcguccgcggcaagaucaaccagggcgcccgcacccucaaccucaccgaggucgacggcaagcccuucauggccuucgacucccccgcccccgucggcuuccccgacuucggcaagugcgacuggcacaugcgcaucuccaagacccccaacaacaccuccuccggcgaccccaugcgcuccgucuccguccagaccaacguccagggcuucgucccccaccucggcuccauccaguucgacgaggucuucaaccaccccaccggcgacuacaucggcaccaucgaguggaucucccagcccuccaccccccccggcaccgacaucaaccucugggagauccccgacuacggcuccucccucucccaggccgccaaccucgccccccccgucuucccccccggcuucggcgaggcccucgucuacuucgucuccgccuuccccggccccaacaaccgcuccgcccccaacgacguccccugccuccucccccaggaguacaucacccacuucgucuccgagcaggcccccaccaugggcgacgccgcccuccuccacuacgucgaccccgacaccaaccgcaaccucggcgaguucaagcucuaccccggcggcuaccucaccugcguccccaacggcgucggcgccggcccccagcagcucccccucaacggcgucuuccucuucgucuccugggucucccgcuucuaccagcucaagcccgucggcaccgccuccaccgcccgcuga

SEQ ID NO: 17251 - RNA, 1608 nt, Artificial Sequence
  derived and/or modified sequence opt2 from VP1__Norovirus_and/or_Norovirus-like__AB045603
augaagauggccuccuccgacgccgcccccuccaacgacggcgccgccggccucguccccgaggccaacaacgagaccauggcccucgagcccgucgccggcgccuccaucgccgccccccucaccggccagaacaacaucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggaggaggacgacguccacaucaaccagcccaccaaguucacccccgucggccucuucgagaacgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccaguccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 17252 - RNA, 1608 nt, Artificial Sequence
  derived and/or modified sequence opt2 from VP1__Norovirus_and/or_Norovirus-like__AF397905
augaagauggccuccuccgacgccgcccccuccaacgacggcgccgccggccucguccccgaggccaacaacgagaccauggcccucgagcccgucgccggcgccuccaucgccgccccccucaccggccagaacaacaucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggagcaggacgacguccacaucaaccagcccaccaaguucacccccgucggccucuucgagaacgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccaguccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 17253 - RNA, 1608 nt, Artificial Sequence
  derived and/or modified sequence opt2 from VP1__Norovirus_and/or_Norovirus-like__AF414420
augaagauggccuccuccgacgccgcccccuccaacgacggcgccgccggccucguccccgaggccaacaacgagaccauggcccucgagcccgucgccggcgccuccaucgccgccccccucaccggccagaacaacaucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucgccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcguccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggaggaggacgacguccacaucaaccagcccaccaaguucacccccgucggccucuucgagaacgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccaguccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 17254 - RNA, 1608 nt, Artificial Sequence
  derived and/or modified sequence opt2 from VP1__Norovirus_and/or_Norovirus-like__AF427119
augaagauggccuccuccgacgccgcccccuccaacgacggcgccgccggccucguccccgaggccaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagauccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacuccuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccgcccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacaucuggaacaugcaggucaccaacaccaacggcacccccuucgaccccaccgaggacguccccgccccccucggcacccccgacuucuccggccgccucuucggcguccucucccagcgcgaccacgacaacgccugccgcucccacgacgccgucaucgccaccaacuccgccaaguucacccccaagcucggcgccauccagaucggcaccugggaggaggacgacguccacaucaaccagcccaccaaguucacccccgucggccucuucgagcacggcgacuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccaguccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 17255 - RNA, 1608 nt, Artificial Sequence
  derived and/or modified sequence opt2 from VP1__Norovirus_and/or_Norovirus-like__AB044366
augaagauggccuccuccgacgccgcccccuccaacgacggcgccgccggccucguccccgaggccaacaacgagaccauggcccucgagcccgucgccggcgccuccaucgccgccccccucaccggccagaacaacaucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggaggaggacgacguccacaucaaccagcccaccaaguucacccccgucggccucuucgaggacggcggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccaguccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 17256 - RNA, 1608 nt, Artificial Sequence
  derived and/or modified sequence opt2 from VP1__Norovirus_and/or_Norovirus-like__AB032758
augaagauggccuccaacgacgccgcccccuccaacgacggcgccgccggccucguccccgaggccaacaacgagaccauggcccucgagcccgucgccggcgccuccaucgccgccccccucaccggccagaacaacaucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccacccucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccggcgacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggaggaggacgacguccacaucaaccagcccaccaaguucacccccgucggccucuucgagaacgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccaguccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacaccugggucaaccaguucuacucccucgcccccaugggcaccggcaacggccgccgccgcguccaguga

SEQ ID NO: 17257 - RNA, 1608 nt, Artificial Sequence
  derived and/or modified sequence opt2 from VP1__Norovirus_and/or_Norovirus-like__AB039775
augaagauggccuccuccgacgccgcccccuccaacgacggcgccgccggccucguccccgaggccaacaacgagaccauggcccucgagcccgucgccggcgccuccaucgccgccccccucaccggccagaacaacaucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccacccucaccaucggcgagcucaccaacucccgcuuccccguccccaucgacgagcucuacaccucccccaacgagucccucgucguccagccccagaacggccgcugcgcccucgacggcgagcuccgcggcaccacccagcuccuccccaccgccaucugccccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggaggaggacgacguccacaucaaccagcccaccaaguucacccccgucggccucuucgagaacgagggcuucaaccaguggacccuccccaacuacuccggcgcccucacccucaacaugggccucgccccccccgucgcccccaccuuccccggcgagcgcauccucuucuuccgcucccacaucccccucaagggcggcgucgccgaccccgucaucgacugccuccuccaccaggaguggauccagcaccucuaccaggaguccgcccccucccaguccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 17258 - RNA, 1608 nt, Artificial Sequence
  derived and/or modified sequence opt2 from VP1__Norovirus_and/or_Norovirus-like__AF414418
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagauccuccucaaccucgagcucggccccggccucaaccccuuccucgcccaccucucccgcauguacaacggcuacgccggcggcgucgagguccagguccuccucgccggcaacgccuucaccgccggcaagcucgucuucgccgccauccccccccacuuccccaucgagaaccucucccccggccagaucaccauguucccccacgucaucaucgacguccgcacccucgagcccguccuccucccccuccccgacguccgcaacaacuucuuccacuacaaccaggagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccgcccccaucgacgagcucuacaccucccccaacgagggccucgucguccagccccagaacggccgcuccacccucgacggcgagcuccucggcaccacccagcucguccccuccaacaucugcucccuccgcggccgcaucaacgcccaccucuccgacaaccagcaccgcuggaacaugcaggucaccaacgccaacggcacccccuucgaccccaccgaggacguccccgccccccucggcacccccgacuuccucgccaacaucuacggcgucaccucccagcgcaaccccgacaacaccugccgcgcccacgacggcauccucgccaccuggucccccaaguucacccccaagcucggcuccgucguccucggcaccugggaggaccgcgacuucgacaucaaccagcccacccgcuucacccccgucggccucuacgacaccgaccacuucaaccagugggcccuccccaacuacuccggcgcccucacccucaacaugaaccucgcccccuccgucgccccccucuuccccggcgagcagcuccucuucuuccgcucccacaucccccucaagggcggcaccuccaacggcgccaucgacugccuccucccccaggaguggguccagcacuucuaccaggaguccgcccccuccuccaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 17259 - RNA, 1608 nt, Artificial Sequence
  derived and/or modified sequence opt2 from VP1__Norovirus_and/or_Norovirus-like__AF425769
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagauccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuuccccaucgagaaccucucccccggccagaucaccauguucccccacgucaucaucgacguccgcacccucgagcccguccuccucccccuccccgacguccgcaacaacuucuuccacuacaaccaggagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccgcccccaucgacgagcucuacaccucccccaacgagggccucgucguccagccccagaacggccgcuccacccucgacggcgagcuccucggcaccacccagcucguccccuccaacaucugcucccuccgcggccgcaucaacgcccaccucuccgacaaccagcaccgcuggaacaugcaggucaccaacgucaacggcacccccuucgaccccaccgaggacguccccgccccccucggcacccccgacuuccucgccaacaucuacggcgucaccucccagcgcaaccccgacaacaccugccgcgcccacgacggcauccucgccaccuggucccccaaguucacccccaagcucggcuccgucguccucggcaccugggaggaccgcgacuucgacaucaaccagcccacccgcuucacccccgucggccucuacgacaccgaccacuucaaccagugggcccuccccaacuacuccggcgcccucacccucaacaugaaccucgcccccuccgucgccccccucuuccccggcgagcagcuccucuucuuccgcucccacaucccccucaagggcggcaccuccaacggcgccaucgacugccuccucccccaggaguggguccagcacuucuaccaggaguccgcccccuccuccaccgacgucgcccucauccgcuacaccaaccccgacaccggccgcguccucuucgaggccgagcuccaccgccagggcuucaucaccgucgccaaccccggcucccgccccaucgucgucccccccaacggcuacuuccgcuucgacuccugggucaaccaguucuacucccucgcccccaugggcaccggcaacggccgccgccgcguccaguga

SEQ ID NO: 17260 - RNA, 1608 nt, Artificial Sequence
  derived and/or modified sequence opt2 from VP1__Norovirus_and/or_Norovirus-like__AF414421
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagauccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuuccccaucgagaaccucucccccggccagaucaccauguucccccacgucaucaucgacguccgcacccucgagcccguccuccucccccuccccgacguccgcaacaacuucuuccacuacaaccaggagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccgcccccaucgacgagcucuacaccucccccaacgagggccucgucguccagccccagaacggccgccccacccucgacggcgagcuccucggcaccacccagcucguccccuccaacaucugcucccuccgcggccgcaucaacgcccaccucuccgacaaccagcaccgcuggaacaugcaggucaccaacgccaacggcacccccuucgaccccaccgaggacgcccccgccccccucggcacccccgacuuccucgccaacaucuacggcgucaccucccagcgcaaccccgacaacaccugccgcgcccacgacggcauccucgccaccuggucccccaaguucacccccaagcucggcuccgucguccucggcaccugggaggaccgcgacuucgacaucaaccagcccacccgcuucacccccgucggccucuacgacaccgaccacuucaaccagugggcccuccccaacuacuccggcgcccucacccucaacaugaaccucgcccccuccgucgccccccucuuccccggcgagcagcuccucuucuuccgcucccacaucccccucaagggcggcaccuccaacggcgccaucgacugccuccucccccaggaguggguccagcacuucuaccaggaguccgcccccuccuccaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 17261 - RNA, 1608 nt, Artificial Sequence
  derived and/or modified sequence opt2 from VP1__Norovirus_and/or_Norovirus-like__AF414416
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagauccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuuccccaucggcaaccucucccccggccagaucgccauguucccccacgucaucaucgacguccgcacccucgagcccguccuccucccccuccccgacguccgcaacaacuucuuccacuacaaccaggagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccguccccaucgacgagcucuacaccucccccaacgagggccucgucguccagccccagaacggccgcuccacccucgacggcgagcuccucggcaccacccagcucguccccuccaacaucugcucccuccgcggccgcaucaacgcccaccucuccgacaaccagcaccgcuggaacaugcaggucaccaacgccaacggcacccccuucgaccccaccgaggacguccccgccccccucggcacccccgacuuccucgccaacaucuacggcgucaccucccagcgcaaccccgacaacaccugccgcgcccacgacggcauccucgccaccuggucccccaaguucacccccaagcucggcuccgucguccucggcaccugggaggaccgcgacuucgacaucaaccagcccacccgcuucacccccgucggccucuacgacaccgaccacuucaaccaguggguccuccccuacuacuccggcgcccucacccucaacaugaaccucgcccccuccgucgccccccucuuccccggcgagcagcuccucuucuuccgcucccacgucccccucaagggcggcaccuccaacggcgccaucgacugccuccucccccaggaguggguccagcacuucuaccaggaguccgcccccuccuccaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 17262 - RNA, 1608 nt, Artificial Sequence
  derived and/or modified sequence opt2 from VP1__Norovirus_and/or_Norovirus-like__AF414419
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagauccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuuccccaucgagaaccucucccccggccagaucaccauguucccccacgucaucaucgacguccgcacccucgagcccguccuccucccccuccccgacguccgcaacaacuucuuccacuacaaccaggagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccucauccucaccaucggcgagcucuccaacucccgcuuccccgcccccaucgacgagcucuacaccucccccaacgagggccucgucguccagccccagaacggccgcuccacccucgacggcgagcuccucggcaccacccagcucguccccuccaacaucugcucccuccgcggccgcaucaacgcccaccucuccgacaaccagcaccgcuggaacaugcaggucaccaacgccaacggcacccccuucgaccccaccgaggacguccccgccccccucggcacccccgacuuccucgccaacaucuacggcgucaccucccagcgcaaccccgacaacaccugccgcgcccacgacggcauccucgccaccuggucccccaaguucacccccaagcucggcuccgucguccucggcaccugggaggaccgcgacuucgacaucaaccagcccgcccgcuucacccccgucggccucuacgacaccgaccacuucaaccagugggcccuccccaacuacuccggcgcccucacccucaacaugaaccucgcccccuccgucgccccccucuuccccggcgagcagcuccucuucuuccgcucccacaucccccucaagggcggcaccuccaacggcgccaucgacugccuccucccccaggaguggguccagcacuucuaccaggaguccgcccccuccuccaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 17263 - RNA, 1608 nt, Artificial Sequence
  derived and/or modified sequence opt2 from VP1__Norovirus_and/or_Norovirus-like__AF425767
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagauccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuuccccaucgagaaccucucccccggccagaucaccauguucccccacgucaucaucgacguccgcacccucgagcccguccuccucccccuccccgacguccgcaacaacuucuuccacuacaaccaggaccccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccgcccccaucgacgagcucuacaccucccccaacgagggccucgucguccagccccagaacggcggcuccacccucgacggcgagcuccucggcaccacccagcucguccccuccaacaucugcucccuccgcggccgcaucaacgcccaccucuccgacaaccagcaccgcuggaacaugcaggucaccaacgucaacggcacccccuucgaccccaccgaggacguccccgccccccucggcacccccgacuuccucgccaacaucuacggcaucaccucccagcgcaaccccgacaacaccugccgcgcccacgacggcauccucgccaccuggucccccaaguucacccccaagcucggcuccgucguccucggcaccugggaggaccgcgacuucgacaucaaccagcccacccgcuucacccccgucggccucuacgacaccgaccacuucaaccagugggcccuccccaacuacuccggcgcccucacccucaacaugaaccucgcccccuccgucgccccccucuuccccggcgagcagcuccucuucuuccgcucccacaucccccucaagggcggcaccuccaacggcgccaucgacugccuccucccccaggaguggguccagcacuucuaccaggaguccgcccccuccuccaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 17264 - RNA, 1608 nt, Artificial Sequence
  derived and/or modified sequence opt2 from VP1__Norovirus_and/or_Norovirus-like__DQ093065
augaagauggccuccaacgacgccgcccccuccaacgacggcgccgccggccucguccccgaggucaacaacgagaugauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagauccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccgcuuccccaucgagaaccucucccccggccagaucaccauguucccccacgucaucaucgacguccgcacccucgagcccguccuccucccccuccccgacguccgcaacaacuucuuccacuacaaccaggagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccgcccccaucgacgagcucuacaccucccccaacgagggccucgucguccagccccagaacggccgcuccacccucgacggcgagcuccucggcaccacccagcucguccccuccaacaucugcucccuccgcggccgcaucaacgcccaccuccccgacaaccagcaccgcuggaacaugcaggucaccaacgccaacggcacccccuucgaccccaccgaggacguccccgccccccucggcacccccgacuuccucgccaacaucuacggcgucaccucccagcgcaaccccgacaacaccugccgcgcccacgacggcauccucgccaccuggucccccaaguucacccccaagcucggcuccgucguccucggcaccugggaggaccgcgacuucgacaucaaccagcccacccgcuucacccccgucggccucuacgacaccgaccacuucaaccagugggcccuccccaacuacuccggcgcccucacccucaacaugaaccucgcccccuccgucgccccccucuuccccggcgagcagcuccucuucuuccgcucccacaucccccucaagggcggcaccuccaacggcgccaucgacugccuccucccccaggaguggguccagcacuucuaccaggaguccgcccccuccuccaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 17265 - RNA, 1608 nt, Artificial Sequence
  derived and/or modified sequence opt2 from VP1__Norovirus_and/or_Norovirus-like__KJ194507
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagguccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuucccccucgagaaccucucccccggccagaucaccauguucccccacgucaucaucgacguccgcacccucgagcccguccuccucccccuccccgacguccgcaacaacuucuuccacuacaaccagcagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccguccccaucgacgagcucuacaccucccccaacgagggcgucgucguccagccccagaacggccgcuccacccucgacggcgagcuccucggcaccacccagcucguccccuccaacaucugcgcccuccgcggccgcaucaacgcccagguccccgacgaccaccaccaguggaaccuccaggucaccaacaccaacggcacccccuucgaccccaccgaggacguccccgccccccucggcacccccgacuuccucgccaacaucuacggcgucaccucccagcgcaaccccaacaacaccugccgcgcccacgacggcguccucgccaccuggucccccaaguucacccccaagcucggcuccgucguccucggcaccugggaggaguccgaccucgaccucaaccagcccacccgcuucacccccgucggccucuucaacaccgaccacuucgaccaguggguccuccccaacuacuccggccgccucacccucaacaugaaccucgcccccuccgucuccccccucuuccccggcgagcagauccucuucuuccgcucccacaucccccucaagggcggcaccuccgacggcgccaucgacugccuccucccccaggaguggauccagcacuucuaccaggaguccgcccccucccccaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 17266 - RNA, 1608 nt, Artificial Sequence
  derived and/or modified sequence opt2 from VP1__Norovirus_and/or_Norovirus-like__KP064099
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgacaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccgacuccgccaaguucacccccaagcucggcgccauccagaucggcaccugggaggaggacgacguccacaucaaccagcccaccaaguucacccccgucggccucuucgagcgcgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 17267 - RNA, 1608 nt, Artificial Sequence
  derived and/or modified sequence opt2 from VP1__Norovirus_and/or_Norovirus-like__AB303926
augaagauggccuccaacgacgccacccccuccgacggcuccaccgccaaccucguccccgaggucaacaacgaggucauggcccucgagcccgucgucggcgccgccaucgccgcccgcgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccgucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcuccaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgcuga

SEQ ID NO: 17268 - RNA, 1608 nt, Artificial Sequence
  derived and/or modified sequence opt2 from VP1__Norovirus_and/or_Norovirus-like__KU985166
augaagauggccuccuccgacgccaaccccuccgacggcuccaccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcggcaucacccgcaucggccaguccgaguccuacaagaugaaccucgccucccagaacuggaacaacuacgaccccaccgaggagauccccgccccccucggcacccccgacuucaagggccgcauccgcggccuccucacccagaccaccaagggcgccggcuccacccgcggccacaaggccaccguccucaccggcggcuccgacuucacccccaagcucggcaccguccgcuucgacaccaaguccaucgacuucgagaacaaccagaacaccaaguucacccccgucggcgucguccaggacggcaacaaccacgacgagcccacccaguggguccuccccaacuacuccggccccgacacccacaacguccaccucgcccccgccgucgcccccaccuuccccggcgagcagcuccucuucuuccgcuccaccaugcccggcugcuccggcuaccccaagauggagcucgacugccuccucccccaggaguggguccagcacuucuaccaggaggccgcccccgcccagaccgacgucgcccuccuccgcuucgucaaccccgacaccggccgcguccucuucgagugcaagcuccacaaguccggcuacgucaccgucgcccacaccggcgaccacgaccucgucaucccccccaacggcuacuuccgcuucgacuccugggucaaccaguucuacacccucgcccccaugggcaacggcaccggccgccgccgcuga

SEQ ID NO: 17269 - RNA, 1608 nt, Artificial Sequence
  derived and/or modified sequence opt2 from VP1__Norovirus_and/or_Norovirus-like__JN699045
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuuccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacgucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccaggcccagaaccaggaccccucccaguccgucaccuucgccaccaacgacgccuccuucguccccuaccucggcuccaucuccccccacaacggcggcgacuuccacuccggcgacaucaucggcucccucggcuggaucuccgcccccuccgacuccucccagcucaacgucuggaccauccccaaguacggcuccucccuccccgacgucacccaccucgcccccgccgucuucccccccggcuucggcgaggucauccucuacuuccacuccaccuuccccggcuccggccagcccggccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucuga

SEQ ID NO: 17270 - RNA, 1608 nt, Artificial Sequence
  derived and/or modified sequence opt2 from VP1__Norovirus_and/or_Norovirus-like__EF547395
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuuccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacgucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcucccccuucaucccccucgagucccccgcccccgucggcuuccccgaccucggcggcugcgacuggcacgucaacuucaccuuccaggcccaggaccaggaccccucccaguccgucaccuucgccaccaacgacgccuccuucguccccuaccucggcuccaucuccccccacaacggcggcgacuuccacuccggcgacaucaucggcucccucggcuggaucuccgcccccuccgacuccucccagcucaacgucuggaccauccccaaguacggcuccucccuccccgacgucacccaccucgcccccgccgucuucccccccggcuucggcgaggucauccucuacuucuacuccaccuuccccggcuccggccagcccggccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgucgcccgccgccucuga

SEQ ID NO: 17271 - RNA, 1608 nt, Artificial Sequence
  derived and/or modified sequence opt2 from VP1__Norovirus_and/or_Norovirus-like__AY502008
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuuccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacgucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcucccccuucaucccccucgagucccccgcccccgucggcuuccccgaccucggcggcugcgacuggcacgucaacuucaccuuccaggcccaggaccaggaccccucccaguccgucaccuucgccaccaacgacgccuccuucguccccuaccucggcuccaucuccccccacaacggcggcgacuuccacuccggcgacaucaucggcucccucggcuggaucuccgcccccuccgacuccucccagcucaacgucuggaccauccccaaguacggcuccucccuccccgacgucacccaccucgcccccgccgucuucccccccggcuucggcgaggucauccucuacuucuacuccaccuuccccggcuccggccagcccguccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgucgcccgccgccucuga

SEQ ID NO: 17272 - RNA, 1608 nt, Artificial Sequence
  derived and/or modified sequence opt2 from VP1__Norovirus_and/or_Norovirus-like__AY502007
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucgucccccucgagucccccgcccccgucggcuuccccgaccucggcggcugcgacuggcacgucaacuucaccuuccaggcccagaaccaggaccccucccaguccgucaccuucgccaccaacgacgccuccuucguccccuaccucggcuccaucuccccccacaacggcggcgacuuccacgccggcgacaucaucggcucccucggcuggaucuccgcccccuccgacaacacccagcucaacgucuggaccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucuga

SEQ ID NO: 17273 - RNA, 1608 nt, Artificial Sequence
  derived and/or modified sequence opt2 from VP1__Norovirus_and/or_Norovirus-like__KC998959
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccguccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccaggcccaggaccaggaccccucccaguccgucaccuucgccaccaacgacgccuccuucguccccuaccucggcuccaucuccccccacaacggcggcgacuuccacgccggcgacaucaucggcucccucggcuggaucuccgcccccuccggcaacucccagcucaacgucugggccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucuga

SEQ ID NO: 17274 - RNA, 1608 nt, Artificial Sequence
  derived and/or modified sequence opt2 from VP1__Norovirus_and/or_Norovirus-like__GQ856464
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccagacccaggaccgcgaccccucccaguccgucaccuucgccaccaacgacgccuccuucguccccuaccucggcuccgucuccccccacaacggcgagggcuuccaggccggcgacaucaucggcucccucggcuggaucuccgcccccuccgacaacucccaguucaacgucugggccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucuga

SEQ ID NO: 17275 - RNA, 1608 nt, Artificial Sequence
  derived and/or modified sequence opt2 from VP1__Norovirus_and/or_Norovirus-like__GQ856463
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacauggucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccagacccaggaccgcgaccccucccaguccgucaccuucgccaccaacgacgccuccuucguccccuaccucggcuccgucuccccccacaacggcgagggcuuccaggccggcgacaucaucggcucccucggcuggaucuccgcccccuccgacaacucccaguucaacgucugggccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucuga

SEQ ID NO: 17276 - RNA, 1608 nt, Artificial Sequence
  derived and/or modified sequence opt2 from VP1__Norovirus_and/or_Norovirus-like__KM036372
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccguccagggcauguucgucucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccagacccaggaccgcgaccccucccaguccgucaccuucgccaccaacgacgccuccuucguccccuaccucggcuccgucuccccccacaacggcgagggcuuccaggccggcgacaucaucggcucccucggcuggaucuccgcccccuccgacaacucccaguucaacgucugggccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucuga

SEQ ID NO: 17277 - RNA, 1608 nt, Artificial Sequence
  derived and/or modified sequence opt2 from VP1__Norovirus_and/or_Norovirus-like__AF538678
augaagauggccuccaaggacgccccccccucccccgacggcgccuccggcgccggccagcucguccccgaggucaacaccgccgaccagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccacccucauccagggcauguucgucucccccgacgucaaccaguccguccaguuccagaacggccgcugccagaucgacggccagcuccagggcaccacccccgucucccucucccagcucugcaagauccgcggcaagaccuccuccaacacccgcguccucaaccucuccgaggucgacggcacccccuucgucccccucgagucccccgcccccgucggcuuccccgacaucggcggcugcgacuggcacgucggcuucaccuucgaggcccgcgaccaggaccccucccagaacgucaccuucgccaccaacgacuccuccuucguccccuaccucggcuccaucuccccccacaacggcgacggcuuccacuccggcgacaucgucggcucccucgacuggaucuccgcccccuccgacggcuccgcccucgacgucugguccauccccaaguacggcuccucccuccccgacgucacccaccucgcccccgucgucuucccccccggcuucggcgaggucauccucuacuuccacuccaaguuccccggcuccggccccaccgacaagcuccgcguccccugccucaugccccaggaguucaucacccacuucugcaacgagcaggcccccaucgccggcgaggccgcccuccuccacuacgucgaccccgacaccggccgcaaccucggcgaguucaagcucuacuccgacggcuucaugaccugcguccccaacuccaucuccuccggcccccagacccuccccaucaacggcgucuucgucuucgucuccugggucucccgcuucuaccagcucaagcccgucggcaccgccuccgccgcccgccgccucuga

SEQ ID NO: 17278 - RNA, 1608 nt, Artificial Sequence
  derived and/or modified sequence opt2 from VP1__Norovirus_and/or_Norovirus-like__KC294198
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuuccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccguccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccaggcccagaaccaggaccccucccaguccgucaccuucgccaccaacgacgccuccuucguccccuaccucggcuccaucuccccccacaacggcggcgacuuccacgccggcgacaucaucggcucccucggcuggaucuccgcccccuccgacaacucccagcucaacgucuggaccauccccaaguacggcuccucccuccccgacgucacccaccucgcccccgccgucuucccccccggcuucggcgaggucauccucuacuucuacuccaccuuccccggcuccggccaguccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucuga

SEQ ID NO: 17279 - RNA, 1608 nt, Artificial Sequence
  derived and/or modified sequence opt2 from VP1__Norovirus_and/or_Norovirus-like__KT732280
augaugauggccuccaaggacgcccccaccucccccgacggcgccuccggcgccggccagcucguccccgaggucaacaccgccgaccagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccacaugaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccacccucauccagggcauguucgucucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucgucccccucgagucccccgcccccgucggcuuccccgaccucggcggcugcgacuggcacgucggcuucaccuucgaggcccgcgaccaggaccccucccagaacgucaccuucgccaccaacgacuccuccuucguccccuaccucggcuccaucuccccccacaacggcgacggcuuccacuccggcgacaucaucggcucccucgacuggaucuccgcccccuccgacggcuccacccucgacgucugguccauccccaaguacggcuccucccuccccgacgucacccaccucgcccccgccgucuucccccccggcuucggcgaggucauccucuacuuccacuccaaguuccccggcuccggccccaccgacaagcuccgcguccccugccucaucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccaucuccuccggcccccagacccuccccaccaacggcgucuucgucuucgucuccugggucucccgcuucuaccagcucaagcccgucggcaccgccuccauggcccgccgccucuga

SEQ ID NO: 17280 - RNA, 1608 nt, Artificial Sequence
  derived and/or modified sequence opt2 from VP1__Norovirus_and/or_Norovirus-like__LC101822
augaugauggccuccaaggacguccccaccucccccgacggcgccuccggcgccggccagcucguccccgaggucaacaccgccgaccagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccacccucauccagggcauguucgucucccccgacgucaaccaguccguccaguuccagaacggccgcugccagaucgacggccagcuccagggcaccacccccgucucccucucccagcucugcaagauccgcggcaagaccuccuccaacacccgcguccucaaccucuccgaggucgacggcacccccuucgucccccucgagucccccgcccccgucggcuuccccgacaucggcggcugcgacuggcacgucggcuucaccuucgaggcccgcgaccagggccccucccagaacgucaccuucgccaccaacgacuccuccuucguccccuaccucggcuccaucuccccccacaacggcgacggcuuccacuccggcgacaucaucggcucccucgacuggaucuccgcccccuccgacggcuccgcccucgacgucugguccauccccaaguacggcuccucccuccccgacgucacccaccucgcccccgccgucuucccccccggcuucggcgaggucauccucuacuuccacuccaaguuccccggcuccggccccaccgacaagcuccgcguccccugccucaugccccaggaguucaucacccacuucugcgacgagcaggcccccaucgccggcgaggccgcccuccuccacuacgucgaccccgacgccggccgcaaccucggcgaguucaagcucuaccccgacggcuucaugaccugcguccccaacuccaucuccuccggcccccagacccuccccaucaacggcgucuucgucuucgucuccugggucucccgcuucuaccagcucaagcccgucggcaccgccuccauggcccgccgccucuga

SEQ ID NO: 17281 - RNA, 1608 nt, Artificial Sequence
  derived and/or modified sequence opt2 from VP1__Norovirus_and/or_Norovirus-like__KP407451
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucuccuuccagacccaggaccgcgaccccucccaguccgucaccuucgccaccaacgacgccuccuucguccccuaccucggcuccgucuccccccacaacggcgagggcuuccaggccggcgacaucaucggcucccucggcuggaucuccgcccccuccgacaacucccaguucaacgucugggccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucuga

SEQ ID NO: 17282 - RNA, 1608 nt, Artificial Sequence
  derived and/or modified sequence opt2 from VP1__Norovirus_and/or_Norovirus-like__LN854564
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccaggcccagaaccaggaccccucccaguccgucaccuucgccaccaacgacgccuccuucguccccuaccucggcuccaucuccccccacaacggcggcgacuuccacgccggcgacaucaucggcucccucggcuggaucuccgcccccuccgacaacucccagcucaacgucuggaccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucuga

SEQ ID NO: 17283 - RNA, 1608 nt, Artificial Sequence
  derived and/or modified sequence opt2 from VP1__Norovirus_and/or_Norovirus-like__JQ388274
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccguccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccaggcccagaaccaggaccccucccaguccgucaccuucgccaccaacgacgccuccuucguccccuaccucggcuccaucuccccccacaacggcggcgacuuccacgccggcgacaucaucggcucccucggcuggaucuccgcccccuccgacaacucccagcucaacgucuggaccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucuga

SEQ ID NO: 17284 - RNA, 1608 nt, Artificial Sequence
  derived and/or modified sequence opt2 from VP1__Norovirus_and/or_Norovirus-like__KP027330
augaugauggccuccaaggacgcccccaccucccccgacggcgccuccggcgccggccagcucguccccgaggucaacaccgccgaccagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccacaugaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccacccucauccagggcauguucgucucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucgucccccucgagucccccgcccccgucggcuuccccgaccucggcggcugcgacuggcacgucggcuucaccuucgaggcccgcgaccaggaccccucccagaacgucaccuucgccaccaacgacuccuccuucguccccuaccucggcuccaucuccccccacaacggcgacggcuuccacuccggcgacaucaucggcucccucgacuggaucuccgcccccuccgacggcuccacccucgacgucugguccauccccaaguacggcuccucccuccccgacgucacccaccucgcccccgccgucuucccccccggcuucggcgaggucauccucuacuuccacuccaaguuccccggcuccggccccaccgacaagcuccgcguccccugccucaucccccaggaguucaucacccacuucugcaacgagcaggcccccaucgccggcgaggccgcccuccuccacuacgucgaccccgacaccggccgcaaccucggcgaguucaagcucuaccccgacggcuacaugaccugcguccccaacuccaucuccuccggcccccagacccuccccaccaacggcgucuucgucuucgucuccugggucucccgcuucuaccagcucaagcccgucggcaccgccuccauggcccgccgccucuga

SEQ ID NO: 17285 - RNA, 1608 nt, Artificial Sequence
  derived and/or modified sequence opt2 from VP1__Norovirus_and/or_Norovirus-like__AF093797
augaugauggccuccaaggacgccccccccucccccgacggcgccuccggcgccggccagcucguccccgaggucaacaccgccgaccagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaaggucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccacccucauccagggcauguucgucucccccgacgucaaccaguccguccaguuccagaacggccgcugccagaucgacggccagcuccagggcaccacccccgucucccucucccagcucugcaagauccgcggccgcaccuccuccaacacccgcguccucaaccucuccgaggucgacggcacccccuucgucccccucgagucccccgcccccgucggcuuccccgacaucggcggcugcgacuggcacgucggcuucaccuucgaggcccgcgaccaggaccccucccagaacgucaccuucgccaccaacgacuccuccuucguccccuaccucggcuccaucuccccccacaacggcgacggcuuccacuccggcgacaucaucggcucccucgacuggaucuccgcccccuccgacggcuccgcccucgacgucugguccauccccaaguacggcuccucccuccccgacgucacccaccucgcccccgccgucuucccccccggcuucggcgaggucauccucuacuuccacuccaaguuccccggcuccggccccaccgacaagcuccgcguccccugccucaucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccaucuccuccggcccccagacccuccccaucaacggcgucuucgucuucgucuccugggucucccgcuucuaccagcucaagcccgucggcaccgccuccgccgcccgccgccucuga

SEQ ID NO: 17286 - RNA, 1608 nt, Artificial Sequence
  derived and/or modified sequence opt2 from VP1__Norovirus_and/or_Norovirus-like__AB810006
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaaccgcggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccccuuccgcuucgacuccugggucaaccaguucuacucccucgcccccaugggcaccggcuga

SEQ ID NO: 17287 - RNA, 1605 nt, Artificial Sequence
  derived and/or modified sequence opt2 from VP1__Norovirus_and/or_Norovirus-like__LC101825
augaugauggccuccaaggacgccacccccuccgccgacggcgccaacggcgccggccagcucguccccgaggucaacaacgccgagccccucccccucgaccccgucgccggcgccuccaccgcccucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcgucauccucgccggcaacgccuucaccgccggcaaggucaucaucugcugcgucccccccggcuuccagucccgcacccucuccaucgcccaggccacccucuucccccacgucaucgccgacguccgcacccucgagccccucgagaucccccucgaggacguccgcaacacccucuaccacaacaacgacucccagcccaccaugcgccuccucugcaugcucuacaccccccuccgcaccggcggcggcuccggcggcaccgacgccuucgucgucgccggccgcguccucaccugccccucccccgacuucaacuuccucuuccucgucccccccaccgucgagcagaagacccgccccuucuccguccccaacaucccccuccagaaccucuccaacucccgcguccccucccucauccaguccaugguccucuccuccgaccacgcccagaccguccaguuccagaacggccgcugcaccaccgacggccaccuccucggcaccacccccgucuccuccggccagcucaugaaguuccgcggcaaggucacccccggcuccaagguccucaaccucaccgagcucgacggcucccccuuccucgccuucgagccccccgcccccgccggcuuccccgaccucggcaagugcgacuggcacaucgagaugucccucuaccaggucaacaaccaggacaaccccaucguccuccgcgccaucgagcccaacuccuccuccuucgucccccaccucggcuccgucuccuucaaccagaacgucgacgccgccggcgacuacgucugcaccauccaguacaccuccccccccuccaacucccacgacgccgacgucgacuucugguccauccccgacuacggcuccaaccucgccgaggccucccagcucgcccccgucgucuacccccccggcuucggcgaggccaucgucuacuucaugucccgcguccccggcuggaaccgcaccaaccgccucaaccucguccccugccuccucccccaggaguucaucggccacuucgucuccgagcaggcccccgccaucggcgaggccgcccuccuccacuacgucgaccccgacaccaaccgcaaccucggcgaguucaagcucuaccccgagggcuucaucaccugcguccccaacggcaccggcccccagcagcucccccucaacggcgucuucgucuucuccuccugggucucccgcuucuaccagcucaagcccgucggcaccgccuccuccgcccgcuga

SEQ ID NO: 17288 - RNA, 1605 nt, Artificial Sequence
  derived and/or modified sequence opt2 from VP1__Norovirus_and/or_Norovirus-like__AB081723
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccaggcccagaaccaggaccccucccaguccgucaccuucgccaccaacgacgccuccuucguccccuaccucggcuccaucuccccccacaacggcggcgacuuccacgccggcgacaucaucggcucccucggcuggaucuccgcccccuccgacaacacccagcucaacgucuggaccauccccaaguacggcuccucccuccagaugucccucacccuccaccuccucugcuccccccgccucugggaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucuga

SEQ ID NO: 17289 - RNA, 1605 nt, Artificial Sequence
  derived and/or modified sequence opt2 from VP1__Norovirus_and/or_Norovirus-like__JN005886
augaugauggccuccaaggacgcccccuccaacauggacggcaccuccggcgccggccagcucguccccgaggucaacgccgccgagccccucccccucgagcccgucgucggcgccgccaccgccgccgccaccgccggccaggucaaccucaucgaccccuggaucaugaacaacuucguccaggcccccgagggcgaguucaccaucucccccaacaacacccccggcgacauccucuucgaccuccaccucggcccccaccucaaccccuuccuccagcaccucucccagauguacaacggcugggucggcaacaugcgcguccgcgucaugcucgccggcaacgccuucaccgccggcaagaucaucaucugcugcgucccccccggcuucgccucccagaacaucuccaucggccaggccaccauguucccccacgucaucgccgacguccgcguccucgagcccaucgagaucccccucgacgacguccgcaacguccucuuccacaccaacgagaaccgccccaccaugcgccuccucugcaugcucuacaccccccuccgcgccggcggcgccuccuccggcaccgaccccuucgucaucgccggccgcguccucaccugccccucccccgacuucaacuuccucuuccucgucccccccuccgucgagcagaagacccgccagcucaccguccccaacaucccccucaacaaccucgccaacucccgcguccccgccaugaucaacaagaugaccgucuccaccgaccagaaccaggucguccaguuccagaacggccgcugcacccucgagggccagcuccucggcaccacccccgucuccgccucccaggucgcccgcauccgcggcaaggucuucuccaccgccuccggcaagggccucaaccucaccgagcucgacggcacccccuaccacgccuucgagucccccgccccccucggcuuccccgacaucggcgccugcgacuggcacgucuccaccuucaaggucgaccagaaccucuccggcgaccccaugucccgccucgacgucaagcagaacgcccccuucgccccccaccucggcuccaucgaguucaccuccgaccaggaccccaccggcgaccagcucggcacccucgccugggucucccccuccaccuccggcgcccgcgucgaccccuggaagauccccuccuacggcuccaccgucaccgaguccacccaccucgccccccccaucuucccccccggcuucggcgaggccaucgucuacuucauguccgacuuccccaucgucuccggcaacaccgcccagguccccugcacccucccccaggaguucgucucccacuucgucgagcagcaggcccccguccgcggcgaggccgcccuccuccacuacgucgaccccgacacccaccgcaaccucggcgaguucaagcucuaccccgacggcuucaucaccugcguccccaacaccggcggcggcccccagaaccuccccaccaacggcgucuucgucuucuccuccugggucucccgcuacuaccagcucaagcccgucggcaccgccggccccgcccgccgccucuga

SEQ ID NO: 17290 - RNA, 1605 nt, Artificial Sequence
  derived and/or modified sequence opt2 from VP1__Norovirus_and/or_Norovirus-like__AB758449
augaugauggccuccaaggacgcccccuccaacauggacggcaccuccggcgccggccagcucguccccgaggucaacgccgccgagccccucccccucgagcccgucgucggcgccgccaccgccgccgccaccgccggccaggucaaccucaucgaccccuggaucaugaacaacuucguccaggcccccgagggcgaguucaccaucucccccaacaacacccccggcgacauccucuucgaccuccagcucggcccccaccucaaccccuuccuccagcaccucucccagauguacaacggcugggucggcaacaugcgcguccgcgucaugcucgccggcaacgccuucaccgccggcaagaucaucaucugcugcgucccccccggcuucgccucccagaacaucuccaucggccaggccaccauguucccccacgucaucgccgacguccgcguccucgagcccaucgagaucccccucgacgacguccgcaacguccucuuccacaccaacgagaaccgccccaccaugcgccuccucugcaugcucuacaccccccuccgcgccggcggcgccuccuccggcaccgaccccuucgucaucgccggccgcguccucaccugccccucccccgacuucaacuuccucuuccucgucccccccuccgucgagcagaagacccgccagcucaccguccccaacaucccccucaacaaccucgccaacucccgcguccccgccaugaucaacaagaugaccgucuccaccgaccagaaccaggucguccaguuccagaacggccgcugcacccucgagggccagcuccucggcaccacccccgucuccgccucccaggucgcccgcauccgcggcaaggucuucuccaccgccuccggcaagggccucaaccucaccgagcucgacggcacccccuaccacgccuucgagucccccgccccccucggcuuccccgacaucggcgccugcgacuggcacgucuccaccuucaaggucgaccagaaccucuccggcgaccccaugucccgccucgacaucaagcagaacgcccccuucgccccccaccucggcuccaucgaguucaccuccgaccaggagcccaccggcgaccagcucggcacccucgccugggucucccccuccaccuccggcgcccgcgucgaccccuggaagauccccuccuacggcuccaccgucaccgaguccacccaccucgccccccccaucuucccccccggcuucggcgaggccaucgucuacuucauguccgacuuccccaucgucuccggcaacaccgcccagguccccugcacccucccccaggaguucgucucccacuucgucgagcagcaggcccccauccgcggcgaggccgcccuccuccacuacgucgaccccgacacccaccgcaaccucggcgaguucaagcucuaccccgacggcuucaucaccugcguccccaacaccggcggcggcccccagaaccuccccaucaacggcgucuucgucuucuccuccugggucucccgcuacuaccagcucaagcccgucggcaccgccggccccgcccgccgccucuga

SEQ ID NO: 17291 - RNA, 1605 nt, Artificial Sequence
  derived and/or modified sequence opt2 from VP1__Norovirus_and/or_Norovirus-like__KX907729
augaugauggccuccaaggacgcccccuccaacauggacggcaccuccggcgccggccagcucguccccgaggucaacgccgccgagccccucccccucgagcccgucgucggcgccgccaccgccgucgccaccgccggccaggucaaccucaucgaccccuggaucaugaacaacuucguccaggcccccgagggcgaguucaccaucucccccaacaacacccccggcgacauccucuucgaccuccagcucggcccccaccucaaccccuuccuccagcaccucucccagauguacaacggcugggucggcaacaugcgcguccgcgucaugcucgccggcaacgccuucaccgccggcaagaucaucaucugcugcgucccccccggcuucgccucccagaacaucuccaucggccaggccaccauguucccccacgucaucgccgacguccgcguccucgagcccaucgagaucccccucgacgacguccgcaacguccucuuccacaccaacgagucccgccccaccaugcgccuccucugcaugcucuacaccccccuccgcgccggcggcgccuccuccggcaccgaccccuucgucaucgccggccgcguccucaccugccccucccccgacuucaacuuccucuuccucgucccccccuccgucgagcagaagacccgccagcucaccguccccaacaucccccucaacaaccucgccaacucccgcguccccgccaugaucaacaagaugaccgucuccaccgaccagucccaggucguccaguuccagaacggccgcugcacccucgagggccagcuccucggcaccacccccgucuccgccucccaggucgcccgcauccgcggcaaggucuucuccaccgccuccggcaagggccucaaccucaccgagcucgacggcacccccuaccacgccuucgagucccccgccccccucggcuuccccgacaucggcgccugcgacuggcacgucuccaccuucaaggucgaccagaaccucuccggcgaccccaugucccgccucgacaucaagcagaacgcccccuucgccccccaccucggcuccaucgaguucaccuccgaccaggagcccaccggcgaccagcucggcacccucgccugggucucccccuccaccuccggcgcccgcgucgaccccuggaagauccccuccuacggcuccaccgucaccgaguccacccaccucgccccccccaucuucccccccggcuucggcgaggccaucgucuacuucauguccgacuuccccaucgucuccggcaacaccgcccagguccccugcacccucccccaggaguucgucucccacuucgucgagcagcaggcccccauccgcggcgaggccgcccuccuccacuacgucgaccccgacacccaccgcaaccucggcgaguucaagcucuaccccgacggcuucaucaccugcguccccaacaccggcggcggcccccagaaccuccccaucaacggcgucuucgucuucuccuccugggucucccgcuacuaccagcucaagcccgucggcaccgccggccccgcccgccgccucuga

SEQ ID NO: 17292 - RNA, 1602 nt, Artificial Sequence
  derived and/or modified sequence opt2 from VP1__Norovirus_and/or_Norovirus-like__JN899243
augaugauggccuccaaggacgcccccuccaacauggacggcaccuccggcgccggccagcucguccccgaggucaacaccgccgagccccucccccucgagcccgucgucggcgccgccaccgccgccgccaccgccggccaggucaaccucaucgaccccuggaucaugaacaacuucguccaggcccccgagggcgaguucaccaucucccccaacaacacccccggcgacauccucuucgaccuccgccucggcccccaccucaaccccuuccuccuccaccucucccagauguacaacggcugggucggcaacaugcgcauccgcgucaugcucgccggcaacgccuucuccgccggcaagaucaucaucugcugcgucccccccggcuucgagucccagaacaucuccaucggccaggccaccauguucccccacgucaucgccgacguccgcguccucgagcccaucgagaucccccucgacgacguccgcaacguccucuaccacaccaacgagaaccgccccaccaugcgccuccucugcaugcucuacaccccccuccgcgccggcggcgccuccuccggcaccgaccccuucgucaucgccggccgcguccucaccugccccgcccccgacuucaacuuccucuuccucgucccccccuccgucgagcagaagacccgccagcucaccauccccaacaucccccucaacaaccucgccaacucccgcguccccgccaugaucaacaagauggccgucuccgccgaccagaaccaggucguccaguuccagaacggccgcugcacccucgagggccagcuccucggcaccacccccgucuccgccaaccaggucgcccgcauccgcggcaaggucuucuccaccaacuccggcaccggccucaaccucaccgagaccgacggcacccccuaccacgccuucgagucccccgccccccucggcuuccccgacaucggcgacugcgacuggcacgucuacgccuucaaggucaaccagaacaccggcgaccccauguaccgccucgacaucacccagggcaacuccuucgccccccaccucggcuccaucgaguucaccuccgaccagcaccccuccggcgaccagcucggcacccucaccuggaucuccccccucaacaacgccucccgcgucgaccccuggaagauccccuccuacggcuccacccucaccgaguccaccaaccucgccccccccaucuucccccccggcuucggcgaggccaucgucuacuucauguccgacuuccccaucgucuccggcaacaccacccagauccccugcacccucccccaggaguucaucuccuccuucgucgagcagcaggcccccauccgcggcgaggccgcccuccuccacuacgucgaccccgacacccaccgcaaccucggcgaguucaagcucuaccccgacggcuucaucaccugcguccccaacaccggcggcggcccccagaaccuccccuccaacggcgucuucaucuucuccuccugggucucccgcuacuaccagcucaagcccgucggcaccgccggccccgcccgccgccucuga

SEQ ID NO: 17293 - RNA, 1602 nt, Artificial Sequence
  derived and/or modified sequence opt2 from VP1__Norovirus_and/or_Norovirus-like__AB810004
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaaccgcggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcuga

SEQ ID NO: 17294 - RNA, 1602 nt, Artificial Sequence
  derived and/or modified sequence opt2 from VP1__Norovirus_and/or_Norovirus-like__JN183163
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagcgcguccucaaccucaccgagcucgacggcucccccuucauggccuucgccgcccccgcccccgccggcuuccccgaccucggcuccugcgacuggcacaucgagauguccaagauccccaacuccuccacccagaacaaccccaucgucgucaacuccgucaagcccaacucccagcaguucgucccccaccucuccuccaucacccucgacgacaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccuga

SEQ ID NO: 17295 - RNA, 1599 nt, Artificial Sequence
  derived and/or modified sequence opt2 from VP1__Norovirus_and/or_Norovirus-like__EU373815
augaagauggccuccaacgacgccucccccuccuccgacggcuccgccaaccucguccccgagaucaacaacgaggucauggcccucgagcccgucgccggcgccgccaucgccgcccccgucgccggccagcagaacaucaucgaccccuggauccgcaacaacuucguccaggcccccggcggcgaguucaccgucuccccccgcaacgcccccggcgagguccuccucaaccucccccucucccccgacaucaaccccuaccucgcccaccucucccgcauguacaacggcuacgccggcggcgucgaggucgaggucguccucgccggcaacgccuucaccgccggcaagaucaucuucgccgccgucccccccaacuucccccccgagaaccucucccccucccagaucaccaugcucccccacaucaucgucgacguccgccagcucgagcccguccgcaucccccuccccgacguccgcaacaacuucuaccacuacucccgcgagaacgacuccacccuccgccucgucgccaugcucuacaccccccuccgcgccaacaacgccggcgacgacgucuucaccgucuccugccgcguccucacccgccccucccccgacuucgacuucaucuuccucgucccccccaccgucgaguccaaguccaagcccuucaccauccccauccucaccaucgaggagaugaccaacucccgcuuccccgccccccucgagaugaugaccaccggccccucccacgacaucgucguccagccccagaacggccgcugcaccaucgacggcguccuccucggcaccacccagcucucccccgucaacaucugcuccaugcgcggcguccccaccaagcgcaccaacggcaccgacaacugcuucguccagcucgagaaccccaacggcuccgccuacgaccccaccgaggacauccccgccguccucggcucccccgacuucgucggcgaguucuacggcaccaucacccagcgcucccccaacaacuccacccgcgcccaccccuucacccucaacaccggcuccccccgcuacacccccaagaucggcuccgucgacauccacgucaccgacgucgacgaccucaacgaccacgagcccgucaagcucacccccgucggccucuccggcuccuccggcuccauccaccaguggcagcuccccaacuacuccggcgucgccacccacaacaugcaccucgcccccuccgucgccccccucuuccccggcgagcagauccucuucuuccgcuccaccguccccggcugcggcggcuaccccaacaccaacaucgacugccucaucccccaggaguggguccagcacuucuaccaggagggcgcccccgcccgcaccgacgucgcccuccuccgcuucaucaaccccgacaccggccgcguccucuucgagugcaagcuccacaagcacggcuucaucaccgucgccuacuccggcaaccacgaccucgucaugccccccaacggcuacuuccgcuucgaguccugggucaaccaguuccacacccucgcccccaugggcaccggccgcgccgaggaguga

SEQ ID NO: 17296 - RNA, 1599 nt, Artificial Sequence
  derived and/or modified sequence opt2 from VP1__Norovirus_and/or_Norovirus-like__KC473547
auggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucuccuuccagacccaggaccgcgaccccucccaguccgucaccuucgccaccaacgacgccuccuucguccccuaccucggcuccgucuccccccacaacggcgagggcuuccaggccggcgacaucaucggcucccucggcuggaucuccgcccccuccgacaacucccaguucaacgucugggccauccccaaguacggcuccucccuccagaugucccccauccuccuccuccucugcuccccccgccucugggaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucuga

SEQ ID NO: 17297 - RNA, 1599 nt, Artificial Sequence
  derived and/or modified sequence opt2 from VP1__Norovirus_and/or_Norovirus-like__GQ266692
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccaguucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgccuccauggccaccuga

SEQ ID NO: 17298 - RNA, 1599 nt, Artificial Sequence
  derived and/or modified sequence opt2 from VP1__Norovirus_and/or_Norovirus-like__GQ266693
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccuccacccgcgucuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccgucgaguucacccccaagcucggccgcauccaguucuccaccgacaccuccaacgacuucgagaccggccagaacacccgcuucacccccgucggcgucauccaggacggcaacaccacccaccagaacgagccccagcagugggcccuccccaacuacuccggcuccggcucccacaacguccaccucgcccccgccgucgcccccuccuuccccggcgagcagcuccucuucuuccgcuccaccaugcccggcugcuccggcuaccccaacaugaaccucgagugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccuggaucaaccaguucuacacccucgccuccauggccaccuga

SEQ ID NO: 17299 - RNA, 1599 nt, Artificial Sequence
  derived and/or modified sequence opt2 from VP1__Norovirus_and/or_Norovirus-like__EU004673
augcgcauguccgacggcgccgcccccaaggccuccggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacaucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccacccgcgccggcgacaagcucaaggucaccaccuucgagaugauccucggccccaccaccaacgucgaccaggcccccuaccagggccgcgucuacgccucccucaccgccgccgccucccucgaccucgucgacggccgcguccgcgccgucccccgcuccaucuacuccuuccaggacguccuccccgaguacaacgacggccuccucgucccccucgccccccccaucggccccuuccuccccggcgagguccuccuccgcuuccgcaccuacaugcgccaggucgacuccuccgacgccgccgccgaggccaucgacugcgcccucccccaggaguucgucuccugguucgccuccaacggcuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuuccagcucgccuccgucggcuccuga

SEQ ID NO: 17300 - RNA, 1599 nt, Artificial Sequence
  derived and/or modified sequence opt2 from VP1__Norovirus_and/or_Norovirus-like__AB601769
augcgcauguccgacggcgccgcccccaaggccaacggcuccgaggccuccggccaggaccucguccucaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgagcgcgccgccccccucggcuaccccgacuucuccggccagcucgagaucgagguccagaccgagaccaccaagcgcggcgagaagcucaaggucaccaccuucgagaugauccucggccccaccaccaacgucgaccaggcccccuaccagggccgcgucuacgccucccucuccgccgccgccucccucgaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccaggucgacuccuccgacgccgccgccgaggccaucgacugcgcccucccccaggaguucgucuccugguucgccuccaacggcuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcuccuga

SEQ ID NO: 17301 - RNA, 1599 nt, Artificial Sequence
  derived and/or modified sequence opt2 from VP1__Norovirus_and/or_Norovirus-like__EU004676
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgcccccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccaggucgacggcacccuccucggcaccacccccgucuccggcuccugggucuccugcuucgccgccgaggccgccuacgaguuccaggccggcaccggcgaggucgucaccuucaccaugaucgagcaggacggcuccgccuacguccccggcgaccgcgccgccccccucggcuaccccgacuucuccggccagcucgagaucgagguccagaccgagaccaccaagaccggcgacaagcuccgcgucaccaccuucgagaugauccucggccccaccaccaacgucgaccaggcccccuaccagggccgcgccuacgccucccucaccgccgccgccucccucgaccucgucgacggccgcguccgcgccgucccccgcuccaucuacuccuuccaggacgagcuccccgaguacaacgacggccuccucgucccccucgcccccccccucggccccuuccuccccggcgagguccuccuccgcuuccgcaccuacaugcgccagcucgacaccgccgacgccgccgcccagcccaucgacugcgcccucccccaggaguucaucuccugguucgccuccaacaacuucaccguccaguccgacgcccuccucguccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcuccuga

SEQ ID NO: 17302 - RNA, 1599 nt, Artificial Sequence
  derived and/or modified sequence opt2 from VP1__Norovirus_and/or_Norovirus-like__JQ237823
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgcccccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccaggucgacggcacccuccucggcaccacccccgucuccggcuccugggucuccugcuucgccgccgaggccgccuacgaguuccaggccggcaccggcgaggucgucaccuucaccaugaucgagcaggacggcuccgccuacguccccggcgaccgcgccgccccccucggcuaccccgacuucuccggccagcucgagaucgagguccagaccgagaccaccaagaccggcgacaagcuccgcgucaccaccuucgagaugauccucggccccaccaccaacgucgaccaggcccccuaccagggccgcgccuacgccucccucaccgccgccgccucccucgaccucgucgacggccgcguccgcgccgucccccgcuccaucuacuccuuccaggacgagcuccccgaguacaacgacggcguccucgucccccucgcccccccccucggccccuuccuccccggcgagguccuccuccgcuuccgcaccuacaugcgccagcucgacaccgccgacgccgccgcccagcccaucgacugcgcccucccccaggaguucaucuccugguucgccuccaacaacuucaccguccaguccgacgcccuccucguccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcuccuga

SEQ ID NO: 17303 - RNA, 1599 nt, Artificial Sequence
  derived and/or modified sequence opt2 from VP1__Norovirus_and/or_Norovirus-like__DQ223043
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccuccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucaccaugaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggccgcgccuacgccucccucaccgccgccgccucccucgaccucgucgacggccgcguccgcgccgucccccgcuccgucuacuccuuccaggacgagcuccccgaguacaacgacggccuccucgucccccucgcccccccccucggccccuuccuccccggcgagguccuccuccgcuuccgcaccuacaugcgccagcucgacaccgccgacgccuccgcccagcccaucgacugcgcccucccccaggaguucaucuccugguucgccuccaacaacuucaccguccaguccgacgcccuccucguccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcuccuga

SEQ ID NO: 17304 - RNA, 1599 nt, Artificial Sequence
  derived and/or modified sequence opt2 from VP1__Norovirus_and/or_Norovirus-like__JX048594
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcgcccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguaccaguccgaggucggcgaggucgccaccuucacccucaucgagcaggacggcuccgccuacguccccggcgaccgcgccgccccccucggcuaccccgacuacuccggccagcucgagaucgagguccagaccgagaccaccaagaccggcgacaagcucaaggucaccaccuucgacaugauccucggccccaccaccaacgucgaccagguccccuaccagggcaaggucuacgccucccucaccaccgccuccucccucgaccucgucgacggccgcgcccgcgccgucccccgcuccgucuacuccuuccaggacguccuccccgaguacaacgacggccuccucgucccccucgcccccccccucggccccuaccuccccggcgagguccuccuccgcuuccgcaccuacaugcgccagcucgacaccgccgacgccgccgcccagcccaucgacugcgcccucccccaggaguucaucuccugguucgccuccaacaacuucaccguccaguccgacgcccuccucauccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcuccuga

SEQ ID NO: 17305 - RNA, 1596 nt, Artificial Sequence
  derived and/or modified sequence opt2 from VP1__Norovirus_and/or_Norovirus-like__GQ266691
augaagauggccuccuccgacgccaaccccuccgacggcuccaccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccaucgaggagaugaccaacucccgcuuccccaucccccucgagaagcucuucaccggccccuccuccgccuucgucguccagccccagaacggccgcugcaccaucgacggcguccuccucggcaccacccagcucucccccgucaacaucugcaccuuccgcggcgacgucacccacaucgagggcuccaaggucuacaccaugaaccucgccucccagaacuggaacaacuacgaccccaccgaggagauccccgccccccucggcacccccgacuucaagggccgcauccagggcguccucacccagaccacccgcuccgacggcuccacccgcggccacaccgccaccgucuccaccggcuccgccgaguucacccccaagcucggccgcauccaguucuccaccgacaccaacaacgacuucgagaccggccagaacaccaaguucacccccgucggcgucguccagaacggcuccaccacccaccagaacgagccccagcagugggagcuccccgacuacuccggccgcggcauccacaacguccaccucgcccccgccgucgcccccaccuaccccggcgagcagauccucuucuuccgcuccaccaugcccggcugcuccggcuaccccaacaugaaccucgacugccuccucccccaggacuggguccgccacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcuga

SEQ ID NO: 17306 - RNA, 1596 nt, Artificial Sequence
  derived and/or modified sequence opt2 from VP1__Norovirus_and/or_Norovirus-like__GQ266690
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggccgcauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccaacuacuccggccgcgacggccacaacguccaccucgcccccgccgucgcccccuccuuccccggcgagcagauccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcuga

SEQ ID NO: 17307 - RNA, 1596 nt, Artificial Sequence
  derived and/or modified sequence opt2 from VP1__Norovirus_and/or_Norovirus-like__JN183164
augaugauggccuccaaggacgcccccaccaacauggacggcaccuccggcgccggccagcucguccccgaggucuccaccgccgagcccaucuccauggagcccgucgccggcgccgccaccgccgccgccaccgccggccaggucaacaugaucgaccccuggaucauguccaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaagguccgcguccuccucgccggcaacgccuucaccgccggcaagaucaucaucuccugcgucccccccggcuucgccgcccagaacgucuccaucgcccaggccaccauguucccccacgucaucgccgacguccgcguccucgagcccaucgaggucccccucgaggacguccgcaacguccucuuccacaacaacgacuccacccccaccaugcgccucaucugcaugcucuacaccccccuccgcgccuccggcuccuccuccggcaccgaccccuucgucaucgccggccgcguccucaccugccccucccccgacuucaacuuccucuuccucgucccccccaacgucgagcagaagaccaagcccuucuccguccccaaccucccccucaacguccucuccaacucccgcguccccucccucaucaaguccaugauggucucccaggaccacggccagaugguccaguuccagaacggccgcgucacccucgacggccagcuccagggcaccacccccaccuccgccucccagcucugcaagauccgcggcaccgucuaccacgccaccggcggccagggccucaaccucaccgagaucgacggcacccccuaccacgccuucgagucccccgcccccaucggcuuccccgaccucggcgagugcgacuggcacaucaacgccucccccgccaacgccuucaccgacggcuccaucauccaccgcaucgacgucgcccaggacuccaccuucgccccccaccucggcaccauccacuacaccaacgccgacuacaacgccaacgucggccucaucugcucccucgaguggcucuccccccccuccggcggcgcccccaaggucaaccccugggccaucccccgcuacggcuccacccucaccgaggccgcccagcucgccccccccaucuacccccccggcuucggcgaggccaucgucuucuucauguccgacuuccccaucgccaacggcuccgacggccucuccguccccugcaccaucccccaggaguucgucacccacuucgucaacgagcaggcccccacccgcggcgaggccgcccuccuccacuacgucgaccccgacacccaccgcaaccucggcgaguucaagcucuaccccgagggcuucaugaccugcguccccaacuccuccggcuccggcccccagacccuccccaucaacggcgucuucaccuucaucuccugggucucccgcuucuaccagcucaagcccgucggcaccuga

SEQ ID NO: 17308 - RNA, 1596 nt, Artificial Sequence
  derived and/or modified sequence opt2 from VP1__Norovirus_and/or_Norovirus-like__AB809995
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccuga

SEQ ID NO: 17309 - RNA, 1593 nt, Artificial Sequence
  derived and/or modified sequence opt2 from VP1__Norovirus_and/or_Norovirus-like__KT732275
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccauguga

SEQ ID NO: 17310 - RNA, 1593 nt, Artificial Sequence
  derived and/or modified sequence opt2 from VP1__Norovirus_and/or_Norovirus-like__AB809998
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgaggccaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccgcgacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgccuga

SEQ ID NO: 17311 - RNA, 1593 nt, Artificial Sequence
  derived and/or modified sequence opt2 from VP1__Norovirus_and/or_Norovirus-like__AB809984
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgccuga

SEQ ID NO: 17312 - RNA, 1590 nt, Artificial Sequence
  derived and/or modified sequence opt2 from VP1__Norovirus_and/or_Norovirus-like__KT732276
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccuga

SEQ ID NO: 17313 - RNA, 1590 nt, Artificial Sequence
  derived and/or modified sequence opt2 from VP1__Norovirus_and/or_Norovirus-like__AB810009
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaaccgcggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucuga

SEQ ID NO: 17314 - RNA, 1590 nt, Artificial Sequence
  derived and/or modified sequence opt2 from VP1__Norovirus_and/or_Norovirus-like__KM461690
augaagauggccuccuccgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucaugcacuccgaguccgacgacuucgucaccggccagcccguccgcuucacccccaucggcaugggcgacaacgacuggcaccagugggagcuccccgacuacuccggccgccucacccucaacaugaaccucgcccccgccgucgcccccgccuuccccggcgagcgcauccucuucuuccgcuccaucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaacuga

SEQ ID NO: 17315 - RNA, 1587 nt, Artificial Sequence
  derived and/or modified sequence opt2 from VP1__Norovirus_and/or_Norovirus-like__JN400618
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccuccccccgcuucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacggccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcuga

SEQ ID NO: 17316 - RNA, 1587 nt, Artificial Sequence
  derived and/or modified sequence opt2 from VP1__Norovirus_and/or_Norovirus-like__JQ653095
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccacaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccccacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggagcaggacgacguccacaucaaccagcccaccaaguucacccccgucggccucuucgaguccgagggcuucaaccaguggacccuccccaacuacuccggcgcccucacccccaacaugggccucgccccccccgucgcccccaccuuccccggcgagcagauccucuucuuccgcucccacaucccccucaagggcggcgucgccgaccccgucaucgacugccucgucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccgucggcaccggcuga

SEQ ID NO: 17317 - RNA, 1587 nt, Artificial Sequence
  derived and/or modified sequence opt2 from VP1__Norovirus_and/or_Norovirus-like__JN183161
augaugauggccuccaaggacgcccccuccaacauggacggcaccuccggcgccggccagcucguccccgaggucaacgccgccgagccccucccccucgagcccgucgucggcgccgccaccgccgccgccaccgccggccaggucaaccucaucgaccccuggaucaugaacaacuucguccaggcccccgagggcgaguucaccaucucccccaacaacacccccggcgacauccucuucgaccuccaccucggcccccaccucaaccccuuccuccagcaccucucccagauguacaacggcugggucggcaacaugcgcguccgcgucaugcucgccggcaacgccuucaccgccggcaagaucaucaucugcugcgucccccccggcuucgccucccagaacaucuccaucggccaggccaccauguucccccacgucaucgccgacguccgcguccucgagcccaucgagaucccccucgacgacguccgcaacguccucuuccacaccaacgagaaccgccccaccaugcgccuccucugcaugcucuacaccccccuccgcgccggcggcgccuccuccggcaccgaccccuucgucaucgccggccgcguccucaccugccccgcccccgacuucaacuuccucuuccucgucccccccuccgucgagcagaagacccgccagcucaccguccccaacaucccccucaacaacauggccaacucccgcguccccgccaugaucaacaagaugaccgucuccuccgaccagaaccaggucguccaguuccagaacggccgcugcacccucgagggccagcuccucggcaccacccccgucuccgccucccaggucgcccgcauccgcggcaaggucuucuccaccgccuccggcaagggccucaaccucaccgagcucgacggcacccccuaccacgccuucgagucccccgccccccucggcuuccccgacaucggcgccugcgacuggcacgucuccaccuucaaggucgaccagaaccucuccggcgaccccaugucccgccucgacaucaagcagaacgcccccuucgccccccaccucggcuccaucgaguucaccuccgaccaggaccccaccggcgaccagcucggcacccucgccugggucucccccuccaccuccggcacccgcgucgaccccuggaagauccccuccuacggcuccaccgucaccgaguccacccaccucgccccccccaucuucccccccggcuucggcgaggccaucgucuacuucauguccgacuuccccaucgucuccggcaacaccgcccagguccccugcacccucccccaggaguucgucucccacuucgucgagcagcaggcccccauccgcggcgaggccgcccuccuccacuacgucgaccccgacacccaccgcaaccucggcgaguucaagcucuaccccgacggcuucaucaccugcguccccaacaccggcggcggcccccagaaccuccccaccaacggcgucuucgucuucuccuccugggucucccgcuacuaccagcucaagcccgucggcaccgccuga

SEQ ID NO: 17318 - RNA, 1587 nt, Artificial Sequence
  derived and/or modified sequence opt2 from VP1__Norovirus_and/or_Norovirus-like__KT906670
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgccuga

SEQ ID NO: 17319 - RNA, 1587 nt, Artificial Sequence
  derived and/or modified sequence opt2 from VP1__Norovirus_and/or_Norovirus-like__KT906671
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccaccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgccuga

SEQ ID NO: 17320 - RNA, 1587 nt, Artificial Sequence
  derived and/or modified sequence opt2 from VP1__Norovirus_and/or_Norovirus-like__AB810013
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaaccgcggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacuccuga

SEQ ID NO: 17321 - RNA, 1584 nt, Artificial Sequence
  derived and/or modified sequence opt2 from VP1__Norovirus_and/or_Norovirus-like__EU096510
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacgcccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucuga

SEQ ID NO: 17322 - RNA, 1584 nt, Artificial Sequence
  derived and/or modified sequence opt2 from VP1__Norovirus_and/or_Norovirus-like__EU096513
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucuga

SEQ ID NO: 17323 - RNA, 1584 nt, Artificial Sequence
  derived and/or modified sequence opt2 from VP1__Norovirus_and/or_Norovirus-like__EU096514
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucuga

SEQ ID NO: 17324 - RNA, 1584 nt, Artificial Sequence
  derived and/or modified sequence opt2 from VP1__Norovirus_and/or_Norovirus-like__EU096512
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucuga

SEQ ID NO: 17325 - RNA, 1581 nt, Artificial Sequence
  derived and/or modified sequence opt2 from VP1__Norovirus_and/or_Norovirus-like__KU311161
augaugauggccuccaaggacgcccccuccaacauggacggcaccuccggcgccggccagcucguccccgaggucaacgccgccgagccccucccccucgagcccgucgucggcgccgccaccgccgccgccaccgccggccaggucaacaugaucgaccccuggaucaugaacaacuucguccaggcccccgagggcgaguucaccaucucccccaacaacacccccggcgacauccucuucgaccuccgccucggcccccaccucaaccccuuccuccuccaccucucccagauguacaacggcugggucggcaacaugcgcguccgcgucaugcucgccggcaacgccuucuccgccggcaagaucaucaucugcugcgucccccccggcuucgagucccagaacaucuccaucggccaggccaccauguucccccacgucaucgccgacguccgcguccucgagcccaucgaggucccccucgacgacguccgcaacguccucuuccacaccaacgagaaccgccccaccaugcgccuccucugcaugcucuacaccccccuccgcgccggcggcgccuccuccggcaccgaccccuucgucaucgccggccgcguccucaccugccccgcccccgacuucaacuuccucuuccucgucccccccuccgucgagcagaagacccgccagcucaccauccccaacaucccccucaacaaccucgccaacucccgcguccccgccaugaucaacaagaugaccgucuccgccgaccagaaccaggucguccaguuccagaacggccgcugcacccucgagggccagcuccucggcaccacccccgucuccgccaaccaggucgcccgcauccgcggcaaggucuucuccaccaacuccggcaccggccucaaccucaccgaggucgacggcacccccuaccacgccuucgagucccccgccccccucggcuuccccgacaucggcaacugcgacuggcacgucuacgccuucaaggucaaccagaacaccggcgaccccauguaccgccucgacaucacccagggcaacuccuucgccccccaccucggcuccaucgaguucuccuccgagaaccaccccuccggcgaccagcucggcacccucaccuggaucuccccccucaacaacgccucccgcgucgaccccuggaagauccccaccuacggcuccacccucaccgaguccaccaaccucgccccccccaucuucccccccggcuucggcgaguccaucgucuacuucauguccgacuuccccaucgucuccggcaacaccgcccagauccccugcacccucccccaggaguucgucuccuccuucgucgagcagcaggcccccauccgcggcgaggccgcccuccuccacuacgucgaccccgacacccaccgcaaccucggcgaguucaagcucuaccccgacggcuucaucaccugcguccccaacaccggcggcggcccccagaaccuccccuccaacggcgucuucgucuucuccuccugggucucccgcuacuaccagcucaagcccgucggcaccuga

SEQ ID NO: 17326 - RNA, 1581 nt, Artificial Sequence
  derived and/or modified sequence opt2 from VP1__Norovirus_and/or_Norovirus-like__KX907730
augaugauggccuccaaggacgcccccuccaacauggacggcaccuccggcgccggccagcucguccccgaggucaacgccgccgagccccucccccucgagcccgucgucggcgccgccaccgccgucgccaccgccggccaggucaacaugaucgaccccuggaucaugaacaacuucguccaggcccccgagggcgaguucaccaucucccccaacaacacccccggcgacauccucuucgaccuccgccucggcccccaccucaaccccuuccuccuccaccucucccagauguacaacggcugggucggcaacaugcgcguccgcgucaugcucgccggcaacgccuucuccgccggcaagaucaucaucugcugcgucccccccggcuucgagucccagaacaucuccaucggccaggccaccauguucccccacgucaucgccgacguccgcguccucgagcccaucgaggucccccucgacgacguccgcaacguccucuuccacaccaacgagaaccgccccaccaugcgccuccucugcaugcucuacaccccccuccgcgccggcggcgccuccuccggcaccgaccccuucgucaucgccggccgcguccucaccugccccgcccccgacuucaacuuccucuuccucgucccccccuccgucgagcagaagacccgccagcucaccauccccaacaucccccucaacaaccucgccaacucccgcguccccgccaugaucaacaagaugaccgucuccgccgaccagaaccaggucguccaguuccagaacggccgcugcacccucgagggccagcuccucggcaccacccccgucuccgccaaccaggucgcccgcauccgcggcaaggucuucuccaccaacuccggcaccggccucaaccucaccgaggucgacggcacccccuaccacgccuucgagucccccgccccccucggcuuccccgacaucggcaacugcgacuggcacgucuacgccuucaaggucaaccagaacaccggcgaccccauguaccgccucgacaucacccagggcaacuccuucgccccccaccucggcuccaucgaguucuccuccgagaaccaccccuccggcgaccagcucggcacccucaccuggaucuccccccucaacaacgccucccgcgucgaccccuggaagauccccaccuacggcuccacccucaccgaguccaccaaccucgccccccccaucuucccccccggcuucggcgaggccaucgucuacuucauguccgacuuccccaucgucuccggcaacaccgcccagauccccugcacccucccccaggaguucgucuccuccuucgucgagcagcaggcccccauccgcggcgaggccgcccuccuccacuacgucgaccccgacacccaccgcaaccucggcgaguucaagcucuaccccgacggcuucaucaccugcguccccaacaccggcggcggcccccagaaccuccccuccaacggcgucuucgucuucuccuccugggucucccgcuacuaccagcucaagcccgucggcaccuga

SEQ ID NO: 17327 - RNA, 1581 nt, Artificial Sequence
  derived and/or modified sequence opt2 from VP1__Norovirus_and/or_Norovirus-like__EU096507
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccgucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcguccucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcuccaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucuga

SEQ ID NO: 17328 - RNA, 1581 nt, Artificial Sequence
  derived and/or modified sequence opt2 from VP1__Norovirus_and/or_Norovirus-like__AB810007
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaaccgcggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuga

SEQ ID NO: 17329 - RNA, 1581 nt, Artificial Sequence
  derived and/or modified sequence opt2 from VP1__Norovirus_and/or_Norovirus-like__AB809989
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuga

SEQ ID NO: 17330 - RNA, 1581 nt, Artificial Sequence
  derived and/or modified sequence opt2 from VP1__Norovirus_and/or_Norovirus-like__AB810000
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgucuacccccucgucgucccccccaacggccacuuccgcuucgacuccugggucaaccaguucuga

SEQ ID NO: 17331 - RNA, 1575 nt, Artificial Sequence
  derived and/or modified sequence opt2 from VP1__Norovirus_and/or_Norovirus-like__AB809999
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaaguccuucacccuccccauccucaccaucuccgagcucaccaacucccgcuuccccacccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcggccucacccaggacaacgucuccgagggcaccggcgaggccaagaacgccaagggcgucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccgcggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaacuga

SEQ ID NO: 17332 - RNA, 1572 nt, Artificial Sequence
  derived and/or modified sequence opt2 from VP1__Norovirus_and/or_Norovirus-like__FJ692501
augaugauggccuccuccgacgccaccccccccuccgagggcgccaccaaccucguccccgaggucaacacccaggucgucccccucgagcccgucgccggcgccgccgccgccgcccccuucaccggccagaacaacgucaucgaccccuggaucuuccagaacuucguccaggccccccagggcgaguucaccgucuccccccgcaacacccccggcgagauccuccuccgcaucccccucggccccaaccucaaccccuuccucgcccaccucucccgcauguacaacgccugggucggcggcauggaggccgagaugauccucgccggcaacgccuucaccgccggcaagcuccucaucgucgcccucccccccggcuucgaggccacccagcucacccccgcccaggccaccgccuucccccacgucaucgccgacguccgcacccucgagcccauccccaucccccuccccgacauccgcaacguccucuuccacuacaacggcgaccccacccccaccauccagaucgucgucaugcucuacaccccccuccgcaccaacggcaacggcgacgacgucuucaccgucuccggccgccuccucacccgccccgcccccgacuucuccuucuccuuccucgucccccccaccgucgagcagaagacccgccccuucacccuccccaaccucgccgucuccgaccucuccaacucccgcuuccccgcccccgucaacauccuccgcgccgaccccaacaccacccucgcccucgacuaccagaacggccgcugcacccucgacggcgcccuccagggcaccacccccaccaacuccuccuuccucggcuaccuccgcggcaccgucgaccgcgucaacuccgaccagguccacguccaccuccgcgagcccaacggcgaccccuuccagcucggccuccccggcccccagggcguccccgacuaccgcgccacccucgacaucuacgucgacugggagaacaagaaccacggcaaccccugcgagggcacccucaacaccggcucccagaccgaguacacccccggccucggcacccucaccuucaacaagaccuccggcgacacccccgagcagggcgaccccgucaucaugcgccucgucgccuuccgcuccaaccucaccgaccagcuccccgccuacaacggcgccuucggccagggcgagaaccucgccccccccgucuccccccccguccccggcgaggucuuccuccaguucggcucccgcuacacccgccucggcgagcgcgagcucgccguccagugccuccuccccuccgaguggaucacccacuucuacuccgaggccgcccccauccagggcgaggccaugcuccuccgcuacguccagcccgaccucggccgcauccucuucgaggccaagcucuacaaggagggcuucgucaccgucgccggcggcaccaaccccgucaccuuccccaucgacggcaccuucgucgccgucuccugggucucccgcaacuucguccucucccccaugggcuccggccagggccgccgccgcuga

SEQ ID NO: 17333 - RNA, 1572 nt, Artificial Sequence
  derived and/or modified sequence opt2 from VP1__Norovirus_and/or_Norovirus-like__FJ692500
augaugauggccuccuccgacgccaccccccccuccgagggcgccaccaaccucguccccgaggucaacacccaggucgucccccucgagcccgucgccggcgccgccgccgccgcccccuucaccggccagaacaacgucaucgaccccuggaucuuccagaacuucguccaggccccccagggcgaguucaccgucuccccccgcaacacccccggcgagauccuccuccgcaucccccucggccccaaccucaaccccuuccucgcccaccucucccgcauguacaacgccugggucggcggcauggaggccgagaugauccucgccggcaacgccuucaccgccggcaagcuccucaucgucgcccucccccccggcuucgaggccacccagcucacccccgcccaggccaccgccuucccccacgucaucgccgacguccgcacccucgagcccauccccaucccccuccccgacauccgcaacguccucuuccacuacaacggcgaccccacccccaccauccagaucgucgucaugcucuacaccccccuccgcaccaacggcaacggcgacgacgucuucaccgucuccggccgccuccucacccgccccgcccccgacuucuccuucuccuuccucgucccccccaccgucgagcagaagacccgcuccuucacccuccccaaccucgccgucuccgaccucuccaacucccgcuuccccgcccccgucaacauccuccgcgccgaccccaacaccacccucgcccucgacuaccagaacggccgcugcacccucgacggcgcccuccagggcaccacccccaccaacuccuccuuccucggcuaccuccgcggcaccgucgaccgcgucaacuccgaccagguccacguccaccuccgcgagcccaacggcgaccccuuccagcucggccuccccggcccccagggcguccccgacuaccgcgccacccucgacaucuacgucgacugggagaacaagaaccacggcaaccccugcgagggcacccucaacaccggcucccagaccgaguacacccccggccucggcacccucaccuucaacaagaccuccggcgacacccccgagcagggcgaccccgucaucaugcgccucgucgccuuccgcuccaaccucaccgaccagcuccccgccuacaacggcgccuucggccagggcgagaaccucgccccccccgucuccccccccguccccggcgaggucuuccuccaguucggcucccgcuacacccgccucggcgagcgcgagcucgccguccagugccuccuccccuccgaguggaucacccacuucuacuccgaggccgcccccauccagggcgaggccaugcuccuccgcuacguccagcccgaccucggccgcauccucuucgaggccaagcucuacaaggagggcuucgucaccgucgccggcggcaccaaccccgucaccuuccccaucgacggcaccuucgucgccgucuccugggucucccgcaacuucguccucucccccaugggcuccggccagggccgccgccgcuga

SEQ ID NO: 17334 - RNA, 1572 nt, Artificial Sequence
  derived and/or modified sequence opt2 from VP1__Norovirus_and/or_Norovirus-like__AB031013
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcggcguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccggcaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucggcuccggcaacuacaucggcguccucuccugggucuccccccccucccaccccuccggcucccaggucgaccucuggaagauccccaacuacggcuccuccaucaccgaggccacccaccucgcccccuccgucuacccccccggcuucggcgagguccucgucuucuucauguccaagauccccggccccggcgccuacucccuccccugccuccucccccaggaguacaucucccaccucgccuccgagcaggcccccaccgucggcgaggccgcccuccuccacuacgucgaccccgacaccggccgcacccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcuga

SEQ ID NO: 17335 - RNA, 1572 nt, Artificial Sequence
  derived and/or modified sequence opt2 from VP1__Norovirus_and/or_Norovirus-like__KU253442
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuccgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccagcuccagaacggccgcugcacccucgacggccgccucgucggcaccacccccgucucccucucccacgucgccaagauccgcggcaccuccaacggcaccgccaucaaccucaccgagcucgacggcacccccuuccaccccuucgagggccccgcccccaucggccuccccgaccucggcggcugcgaccgccacaucaacaugacccaguucggccacuccucccagacccagcacgacgccgacaccacccccgacaccuccgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcuga

SEQ ID NO: 17336 - RNA, 1572 nt, Artificial Sequence
  derived and/or modified sequence opt2 from VP1__Norovirus_and/or_Norovirus-like__EF547392
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccggcaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcgucuccuccggcaacuacaucggcguccucuccugggucuccccccccucccaccccuccggcucccaggucgaccucuggaagauccccaacuacggcuccuccaucaccgaggccacccaccucgcccccuccgucuacccccccggcuucggcgagguccucgucuucuucauguccaagauccccggccccggcgccuacucccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccaccgcccgcuga

SEQ ID NO: 17337 - RNA, 1572 nt, Artificial Sequence
  derived and/or modified sequence opt2 from VP1__Norovirus_and/or_Norovirus-like__KT943503
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcuga

SEQ ID NO: 17338 - RNA, 1572 nt, Artificial Sequence
  derived and/or modified sequence opt2 from VP1__Norovirus_and/or_Norovirus-like__AY502016
augaugauggccuccaaggacgccaccuccaacgucgacggcgccuccggcgccggccagcucguccccgaggccaacaccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaguccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccaggucgccaagauccgcggcaccuccaacggcaccgucaucaaccucaccgagcucgacggcacccccuuccaccccuucgagggccccgcccccaucggcuuccccgaccucggcggcugcgacuggcacgucaacaugacccaguucggccacuccucccagacccaguucgacgucgacaccacccccgagaccuucgucccccaccucggcuccauccaggccaacggcgucggcuccggcaacuacaucggcguccucuccuggaucuccccccccucccaccccuccggcucccaggucgaccucuggaagauccccaacuacggcuccuccaucaccgaggccacccaccucgcccccuccgucuucccccccggcuucggcgagguccucgucuucuucauguccaagauccccggccccggcgccuacaaccuccccugccuccucccccaggaguacaucucccacuucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcuga

SEQ ID NO: 17339 - RNA, 1572 nt, Artificial Sequence
  derived and/or modified sequence opt2 from VP1__Norovirus_and/or_Norovirus-like__KU253446
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaucggcgucuucgucuucgucuccugggucucccgcuucuaccagcucaagcccgucggcaccgccuccuccgcccgcuga

SEQ ID NO: 17340 - RNA, 1572 nt, Artificial Sequence
  derived and/or modified sequence opt2 from VP1__Norovirus_and/or_Norovirus-like__KU253445
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccucgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcuga

SEQ ID NO: 17341 - RNA, 1572 nt, Artificial Sequence
  derived and/or modified sequence opt2 from VP1__Norovirus_and/or_Norovirus-like__KF039735
augaugauggccuccaaggacgccaccuccuccgucgacggcgccuccggcgccggccagcucguccccgaggucaacgccuccgacccccucgccauggaccccgucgccggcuccuccaccgccgucgccaccaccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcuga

SEQ ID NO: 17342 - RNA, 1572 nt, Artificial Sequence
  derived and/or modified sequence opt2 from VP1__Norovirus_and/or_Norovirus-like__KF039732
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgucaccuucgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcuga

SEQ ID NO: 17343 - RNA, 1572 nt, Artificial Sequence
  derived and/or modified sequence opt2 from VP1__Norovirus_and/or_Norovirus-like__KF039734
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucggcuccggcaacuacgucggcguccucuccuggaucuccccccccucccgccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcuga

SEQ ID NO: 17344 - RNA, 1572 nt, Artificial Sequence
  derived and/or modified sequence opt2 from VP1__Norovirus_and/or_Norovirus-like__KF039729
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcgucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcuga

SEQ ID NO: 17345 - RNA, 1572 nt, Artificial Sequence
  derived and/or modified sequence opt2 from VP1__Norovirus_and/or_Norovirus-like__KF039737
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucaacaccacccccgacaccuucgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcuga

SEQ ID NO: 17346 - RNA, 1572 nt, Artificial Sequence
  derived and/or modified sequence opt2 from VP1__Norovirus_and/or_Norovirus-like__KF039731
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaucuucgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcuga

SEQ ID NO: 17347 - RNA, 1563 nt, Artificial Sequence
  derived and/or modified sequence opt2 from VP1__Norovirus_and/or_Norovirus-like__KT732279
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacucccucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccggcaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucaacuccggcaacuacaucggcguccucuccugggucuccccccccucccaccccuccggcucccaggucgaccucuggaagauccccaacuacggcuccuccaucaccgaggccacccaccucgcccccuccgucuucccccccggcuucggcgagguccucgucuucuucauguccaagauccccggccccggcgccuacucccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuga

SEQ ID NO: 17348 - RNA, 1563 nt, Artificial Sequence
  derived and/or modified sequence opt2 from VP1__Norovirus_and/or_Norovirus-like__FJ384783
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccggcaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucaacuccggcaacuacaucggcguccucuccugggucuccccccccucccaccccuccggcucccaggucgaccucuggaagauccccaacuacggcuccuccaucaccgaggccacccaccucgcccccuccgucuucccccccggcuucggcgagguccucgucuucuucauguccaagauccccggccccggcgccuacucccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuga

SEQ ID NO: 17349 - RNA, 1563 nt, Artificial Sequence
  derived and/or modified sequence opt2 from VP1__Norovirus_and/or_Norovirus-like__EU085522
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcuccggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccggcaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucaacuccggcaacuacaucggcguccucuccugggucuccccccccucccaccccuccggcucccaggucgaccucuggaagauccccaacuacggcuccuccaucaccgaggccacccaccucgcccccuccgucuucccccccggcuucggcgagguccucgucuucuucauguccaagauccccggccccggcgccuacucccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuga

SEQ ID NO: 17350 - RNA, 1563 nt, Artificial Sequence
  derived and/or modified sequence opt2 from VP1__Norovirus_and/or_Norovirus-like__L23828
augaugauggccuccaaggacgccaccuccuccgucgacggcgccuccgccuccguccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccagcagcucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccucuccaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccggcaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuccgucccccaccucggcuccauccaggccaacggcaucggcuccggcaacuacaucggcguccucuccugggucuccccccccucccaccccuccggcucccaggucgaccucuggaagauccccaacuacggcuccuccaucaccgaggccacccaccucgcccccuccgucuacucccccggcuucggcgagguccucgucuucuucauguccaagauccccggccccggcggcgacucccuccccugccuccucccccagggcuacaucucccaccucgccuccgagcaggcccccaccgucggcgagggcccccuccuccacuacgucgaccccgacaccgaccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuga

SEQ ID NO: 17351 - RNA, 1563 nt, Artificial Sequence
  derived and/or modified sequence opt2 from VP1__Norovirus_and/or_Norovirus-like__KX764843
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagguccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacgccugguga

SEQ ID NO: 17352 - RNA, 1563 nt, Artificial Sequence
  derived and/or modified sequence opt2 from VP1__Norovirus_and/or_Norovirus-like__KX764841
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcgcaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcggcuacccccucgucguccccgccaacggccacuuccgcuucgaguccugguga

SEQ ID NO: 17353 - RNA, 1563 nt, Artificial Sequence
  derived and/or modified sequence opt2 from VP1__Norovirus_and/or_Norovirus-like__KX764840
augaagauggccuccuccgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugguga

SEQ ID NO: 17354 - RNA, 1563 nt, Artificial Sequence
  derived and/or modified sequence opt2 from VP1__Norovirus_and/or_Norovirus-like__KT864687
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgaguccugguga

SEQ ID NO: 17355 - RNA, 1563 nt, Artificial Sequence
  derived and/or modified sequence opt2 from VP1__Norovirus_and/or_Norovirus-like__KX764842
augaagauggccuccaacgacgucgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacgccugguga

SEQ ID NO: 17356 - RNA, 1563 nt, Artificial Sequence
  derived and/or modified sequence opt2 from VP1__Norovirus_and/or_Norovirus-like__KT864685
augaagauggccuccuccgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggccccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugguga

SEQ ID NO: 17357 - RNA, 1563 nt, Artificial Sequence
  derived and/or modified sequence opt2 from VP1__Norovirus_and/or_Norovirus-like__KT864684
augaagauggccuccuccgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgaguccugguga

SEQ ID NO: 17358 - RNA, 1563 nt, Artificial Sequence
  derived and/or modified sequence opt2 from VP1__Norovirus_and/or_Norovirus-like__KX764836
augaagauggccuccuccgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcgucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgaggccugguga

SEQ ID NO: 17359 - RNA, 1563 nt, Artificial Sequence
  derived and/or modified sequence opt2 from VP1__Norovirus_and/or_Norovirus-like__KX764845
augaagauggccuccuccgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacucccuccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgaggccugguga

SEQ ID NO: 17360 - RNA, 1563 nt, Artificial Sequence
  derived and/or modified sequence opt2 from VP1__Norovirus_and/or_Norovirus-like__KX764837
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcgccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacguccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcgucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacgccugguga

SEQ ID NO: 17361 - RNA, 1563 nt, Artificial Sequence
  derived and/or modified sequence opt2 from VP1__Norovirus_and/or_Norovirus-like__KX764838
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucucccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccaggucguccccuccggcaucugcgccuuccgcggccgcgucaccgcccagaucaaccagcgcgaccgcuggcacaugcagcuccagaaccucaacuccaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucgccgucgcccacuccggcgacuacccccucgucguccccgccaacggccacuuccgcuucgacuccugguga

SEQ ID NO: 17362 - RNA, 1563 nt, Artificial Sequence
  derived and/or modified sequence opt2 from VP1__Norovirus_and/or_Norovirus-like__KU687016
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccuuccgcguccucacccgccccacccccgacuucgaguucaccuaccucgucccccccuccgucgagucccgcaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccaggucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccaucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacgccugguga

SEQ ID NO: 17363 - RNA, 1563 nt, Artificial Sequence
  derived and/or modified sequence opt2 from VP1__Norovirus_and/or_Norovirus-like__KU687015
augaagauggccuccuccgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccguccuccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacccccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacauccagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccaucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacgccugguga

SEQ ID NO: 17364 - RNA, 1563 nt, Artificial Sequence
  derived and/or modified sequence opt2 from VP1__Norovirus_and/or_Norovirus-like__KU687013
augaagauggccuccuccgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcggcgacgucuucaccgucuccugccgcguccucacccgccccacccccgacuucgaguucaccuaccucgucccccccuccgucaaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccaucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgaguccugguga

SEQ ID NO: 17365 - RNA, 1563 nt, Artificial Sequence
  derived and/or modified sequence opt2 from VP1__Norovirus_and/or_Norovirus-like__KX764839
augaagauggccuccuccgacgccgcccccuccaacgacggcgccgccggccucguccccgagggcaacaacgagacccucccccucgagcccgucgccggcaccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucggccccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgaggccugguga

SEQ ID NO: 17366 - RNA, 1563 nt, Artificial Sequence
  derived and/or modified sequence opt2 from VP1__Norovirus_and/or_Norovirus-like__KX764844
augaagauggccuccaacgacgccgcccccuccaacgacggcgccgccggccucguccccgagggcaacaacggcacccucccccucgagcccgucgccggcgccgccaucgccgcccccgucaccggccagaacaacaucaucgaccccuggauccgcaucaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugggccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgaguccugguga

SEQ ID NO: 17367 - RNA, 1563 nt, Artificial Sequence
  derived and/or modified sequence opt2 from VP1__Norovirus_and/or_Norovirus-like__KT864686
augaagauggccuccuccgacgccgcccccuccaacgacggcgccgccggccucguccccgagggcaacaacgagacccucccccucgagcccgucgucggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccgacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcggccagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgaguccugguga

SEQ ID NO: 17368 - RNA, 1563 nt, Artificial Sequence
  derived and/or modified sequence opt2 from VP1__Norovirus_and/or_Norovirus-like__KU687012
augaagauggccuccuccgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaccgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacaccgacauccucguccagccccagaacggccgcugcacccucgacggcgagcuccagggcaccacccagcuccucaccaccgccaucugcuccuaccgcggcaccaccuccaaccccaccuccgacuacugggacgaccaccuccuccaccucguccaccccaacggcgccaccuacgaccccaccgaggacguccccgcccccuucggcacccaggacuuccgcggcauccucuacggcguccucacccagaacacccaguccccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcacccaccccacccaggagaucgacugccucaucccccaggaguggaucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgacuccugguga

SEQ ID NO: 17369 - RNA, 1563 nt, Artificial Sequence
  derived and/or modified sequence opt2 from VP1__Norovirus_and/or_Norovirus-like__KU687018
augaagauggccuccaacgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgcccgcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacgucgucguccagccccagaacggccgcugcacccucgacggcgagcuccagggcaccacccagcuccucaccaccgccaucugcuccuaccgcggcaccaccuccaaccccaccuccgacuacugggacgaccaccuccuccaccucguccaccccaacggcgccaccuacgaccccaccgaggacguccccgcccccuucggcacccaggacuuccgcggcauccucuacggcguccucacccagaacacccagaacccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcaaccaccccacccaggagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgaguccugguga

SEQ ID NO: 17370 - RNA, 1563 nt, Artificial Sequence
  derived and/or modified sequence opt2 from VP1__Norovirus_and/or_Norovirus-like__KU687021
augaagauggccuccaacgacgccacccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacgucgucguccagccccagaacggccgcugcacccucgacggcgagcuccagggcaccacccagcuccucaccaccgccaucugcuccuaccgcggcaccaccuccaaccccaccuccgacuacugggacgaccaccuccuccaccucguccaccccaacggcgccaccuacgaccccaccgaggacguccccgcccccuucggcacccaggacuuccgcggcauccucuacggcguccucacccagaacacccagaacccccgcgacaaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcaaccaccccacccaggagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaucaucaucgccgccaccggcuccaaccccgucgucgucccccccaacggcuacuuccgcuucgaguccugguga

SEQ ID NO: 17371 - RNA, 1563 nt, Artificial Sequence
  derived and/or modified sequence opt2 from VP1__Norovirus_and/or_Norovirus-like__KU687020
augaagauggccuccuccgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacgccucccccaacgccgacgucgucguccagccccagaacggccgcugcacccucgacggcgagcuccagggcaccacccagcuccucaccaccgccaucugcuccuaccgcggcaccaccuccaaccccaccuccgacuacugggacgaccaccuccuccaccucguccaccccaacggcgccaccuacgaccccaccgaggacguccccgcccccuucggcacccaggacuuccgcggcauccucuacggcguccucacccagaacacccagaacccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcaaccaccccacccaggagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgacgccugguga

SEQ ID NO: 17372 - RNA, 1563 nt, Artificial Sequence
  derived and/or modified sequence opt2 from VP1__Norovirus_and/or_Norovirus-like__KU687014
augaagauggccuccaacgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucauccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacgucgucguccagccccagaacggccgcugcacccucgacggcgagcuccagggcaccacccagcuccucaccaccgccaucugcuccuaccgcggcaccaccuccaaccccaccuccgacuacugggacgaccaccuccuccaccucguccaccccaacggcgccaccuacggccccaccgaggacguccccgcccccuucggcacccaggacuuccgcggcauccucuacggcguccucacccagaacacccagaacccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcacccaccccacccaggagaucgacugccucaucccccaggaguggaucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgacgccugguga

SEQ ID NO: 17373 - RNA, 1563 nt, Artificial Sequence
  derived and/or modified sequence opt2 from VP1__Norovirus_and/or_Norovirus-like__KU687019
augaagauggccuccaacgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuccacccuccccauccucaccaucggcgagcucaccaacucccgcuuccccgcccccaucgaccagcucuacaccucccccaacgccgacgucgucguccagccccagaacggccgcugcacccucgacggcgagcuccagggcaccacccagcuccucaccaccgccaucugcuccuaccgcggcaccaccuccaaccccaccuccgacuacugggacgaccaccuccuccaccucguccaccccaacggcgccaccuacgaccccaccgaggacguccccgcccccuucggcacccaggacuuccgcggcauccucuacggcguccucacccagaacacccagaacccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccgaccucgcccccgccgucggccccaacuuccccggcgagcagauccucuucuuccgcuccaacguccccuccguccagggcaaccaccccacccaggagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaccaccaucgccgccaccggcuccaaccccgucgucgucccccccaacggcuacuuccgcuucgaguccugguga

SEQ ID NO: 17374 - RNA, 1563 nt, Artificial Sequence
  derived and/or modified sequence opt2 from VP1__Norovirus_and/or_Norovirus-like__KU687017
augaagauggccuccuccgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccguccucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacgucgucguccagccccagaacggccgcugcacccucgacggcgagcuccagggcaccacccagcuccucaccaccgccaucugcuccuaccgcggcaccaccuccaaccccaccuccgacuacugggacgaccaccuccuccaccucguccaccccaacggcgccaccuacgaccccaccgaggacguccccgcccccuucggcacccaggacuuccgcggcauccucuacggcguccucacccaggacacccagaacccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcaaccaccccacccaggagaucgacugccucaucccccaggagugggucucccacuucuaccaggaguccgcccccucccaguccgacgucgcccucguccgcuacgucaaccccgacgccggccgcaccaucuucgaggccaagcuccaccgccagggcuucaucaccaucgccgccaccggcuccaaccccgucgucgucccccccaacggcuacuuccgcuucgaggccugguga

SEQ ID NO: 17375 - RNA, 1563 nt, Artificial Sequence
  derived and/or modified sequence opt2 from VP1__Norovirus_and/or_Norovirus-like__KU687024
augaagauggccuccuccgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguccaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcgccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacaccgacauccucguccagccccagaacggccgcugcacccucgacggcgagcuccagggcaccacccagcuccucaccaccgccaucugcuccuaccgcggcaccaccuccaaccccaccuccgacuacugggacgaccaccuccuccaccucguccaccccaacggcgccaccuacgaccccaccgaggacguccccgcccccuucggcacccaggacuuccgcggcauccucuacggcguccucacccagaacacccagaacccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcacccaccccacccaggagaucgacugccucaucccccaggaguggaucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgaggccugguga

SEQ ID NO: 17376 - RNA, 1563 nt, Artificial Sequence
  derived and/or modified sequence opt2 from VP1__Norovirus_and/or_Norovirus-like__KU687022
augaagauggccuccaacgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccccucccgcauguacaacggcuacgccggcggcgucgagguccagguccuccucgccggcaacgccuucaccgccggcaagauccucuucgccgccgucccccccaacuuccccgucgacaugcucucccccacccagaucaccaugcucccccaccucaccgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacguccucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacgucgucguccagccccagaacggccgcugcacccucgacggcgagcuccagggcaccacccagcuccucaccaccgccaucugcuccuaccgcggcaccaccuccaaccccaccuccgacuacugggacgaccaccuccuccaccucguccaccccaacggcgccaccuacgaccccaccgaggacguccccgcccccuucggcacccaggacuuccgcggcauccucuacggcguccucacccagaacacccagaacccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcaaccaccccacccaggagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgaguccugguga

SEQ ID NO: 17377 - RNA, 1563 nt, Artificial Sequence
  derived and/or modified sequence opt2 from VP1__Norovirus_and/or_Norovirus-like__KU687023
augaagauggccuccuccgacgccgcccccuccaacgacggcgccgccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacaccgacauccucguccagccccagaacggccgcugcacccucgacggcgagcuccagggcaccacccagcuccucaccaccgccaucugcuccuaccgcggcaccaccuccaaccccaccuccgacuacugggacggccaccuccuccaccucguccaccccaacggcgccaccuacgaccccaccgaggacguccccgcccccuucggcacccaggacuuccgcggcauccucuacggcguccucacccagaacacccagaacccccgcgacgaggucuccaacucccgcggcaucuacaucuccuccaccuccgacaaguucacccccaagcucggcaccaucggccuccaccagguccagggcgacaccgccuccaaccagcaguccaaguucacccccgucggcaucgccgucaaccagaacacccccuucaagcagugggagcuccccaacuacuccggcgcccucacccucaacaccaaccucgcccccgccgucggccccaacuuccccggcgagcagauccucuucuuccgcuccaacguccccuccguccagggcacccaccccacccaggagaucgacugccucaucccccaggaguggaucucccacuucuaccaggaguccgcccccucccaguccgacgucgcccucguccgcuacgucaaccccgacaccggccgcaccaucuucgaggccaagcuccaccgccagggcuucaucgccaucgccgccaccggcuccaaccccgucgucgucccccccaacggcuacuuccgcuucgaggccugguga

SEQ ID NO: 17378 - RNA, 1563 nt, Artificial Sequence
  derived and/or modified sequence opt2 from VP1__Norovirus_and/or_Norovirus-like__KX764847
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcuccuccaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgaggccugguga

SEQ ID NO: 17379 - RNA, 1563 nt, Artificial Sequence
  derived and/or modified sequence opt2 from VP1__Norovirus_and/or_Norovirus-like__KX764846
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacccccccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacgccugguga

SEQ ID NO: 17380 - RNA, 1563 nt, Artificial Sequence
  derived and/or modified sequence opt2 from VP1__Norovirus_and/or_Norovirus-like__KX764833
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccaccgcgccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacgccugguga

SEQ ID NO: 17381 - RNA, 1563 nt, Artificial Sequence
  derived and/or modified sequence opt2 from VP1__Norovirus_and/or_Norovirus-like__KX764834
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucgacaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugguga

SEQ ID NO: 17382 - RNA, 1563 nt, Artificial Sequence
  derived and/or modified sequence opt2 from VP1__Norovirus_and/or_Norovirus-like__KU687027
augaagauggccuccaacgacgccaaccccuccgacggcuccgccgccaaccucguccccgaggucaacaacgaggucauggcccucgagcccgucgucggcgccgccaucgccgcccucgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccauccagcucucccccgucaacaucugcaccuuccgcggcgacgucacccacaucaccggcucccgcaacuacaccaugaaccucgccucccagaacuggaacgacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccacccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgaguccugguga

SEQ ID NO: 17383 - RNA, 1563 nt, Artificial Sequence
  derived and/or modified sequence opt2 from VP1__Norovirus_and/or_Norovirus-like__KX764835
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacacccccccccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaaguuccacaaguccggcuacgucaccgucgcccacaccggccagcacgaccucgucaucccccccaacggcuacuuccgcuucgaguccugguga

SEQ ID NO: 17384 - RNA, 1563 nt, Artificial Sequence
  derived and/or modified sequence opt2 from VP1__Norovirus_and/or_Norovirus-like__KX764832
augaagauggccuccaacgacgucaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcagugggcccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccaacaccggccgcguccucuucgagugcaagcuccacaaguccggccacgucaccgucgcccacaccggccagcacgaccucgucaucccccccaacggcuacuuccgcuucgacuccugguga

SEQ ID NO: 17385 - RNA, 1563 nt, Artificial Sequence
  derived and/or modified sequence opt2 from VP1__Norovirus_and/or_Norovirus-like__KU687025
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaaggucaucuucgccgccgucccccccaacuuccccaccgaggaccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccauccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcgcccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccacccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacgccggccagcacgaccucgucaucccccccaacggcuacuuccgcuucgaggccugguga

SEQ ID NO: 17386 - RNA, 1563 nt, Artificial Sequence
  derived and/or modified sequence opt2 from VP1__Norovirus_and/or_Norovirus-like__KU687026
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugcaagguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccauccagcucucccccgucaacaucugcaccuuccgcggcgacgucacccacaucaccggcucccgcaacuacaccaugaaccucgccucccagaacuggaacaacugcgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccacccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacgccugguga

SEQ ID NO: 17387 - RNA, 1563 nt, Artificial Sequence
  derived and/or modified sequence opt2 from VP1__Norovirus_and/or_Norovirus-like__KU687028
augaagauggccuccaacgacgccaaccccuccgacggcuccgccgccaaccucguccccgaggucaacaacgaggucauggcccucgagcccgccgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucgccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccauccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucccccccaccuuccccggcgagcagcuccucuucuuccgcuccaccacccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgaguccugguga

SEQ ID NO: 17388 - RNA, 1563 nt, Artificial Sequence
  derived and/or modified sequence opt2 from VP1__Norovirus_and/or_Norovirus-like__KX764831
augaagauggccuccuccgacgucaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccggcggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggccccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgaggccugguga

SEQ ID NO: 17389 - RNA, 1560 nt, Artificial Sequence
  derived and/or modified sequence opt2 from VP1__Norovirus_and/or_Norovirus-like__JN222366
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccaggcccagaaccaggaccccucccaguccgucaccuucgccaccaacgacgccuccuucguccccuaccucggcuccaucuccccccacaacggcggcgacuuccacgccggcgacaucaucggcucccucggcuggaucuccgcccccuccgacaacucccagcucaacgucuggaccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuga

SEQ ID NO: 17390 - RNA, 1557 nt, Artificial Sequence
  derived and/or modified sequence opt2 from VP1__Norovirus_and/or_Norovirus-like__KM386679
augaagauggccuccaacgacgccacccccuccaacgacggcgccgccggccucguccccgaguccaacaacgaggccauggcccucgagcccgucgucggcgccucccucgccgcccccgucaccggccagaccaacaucaucgaccccuggauccgcaccaacuucguccaggcccccaacggcgaguucaccgucuccccccgcaacucccccggcgagauccucgucaaccucgagcucggccccgagcucaaccccuaccucgcccaccucgcccgcauguacaacggcuacgccggcggcauggagguccaggucaugcucgccggcaacgccuucaccgccggcaagaucaucuucgccgccgucccccccuacuuccccgucgagaaccucucccccucccagaucaccauguucccccacgucaucaucgacguccgcacccucgagcccguccuccuccccaugcccgacguccgcuccacccucuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucgacggcgagcuccucggcaccacccagcuccaggccugcaacaucugcuccauccgcggcaaggucaccggccagguccccaacgagcagcacauguggaaccucgagaucaccaaccucaacggcacccaguucgaccccaccgacgacguccccgccccccucggcguccccgacuucgccggcgaggucuucggcguccucucccagcgcaaccgcggcgaguccaaccccgccaaccgcgcccacgacgccgucgucgccaccuacuccgacaaguacacccccaagcucggccucguccagaucggcaccuggaacaccaacgacgucgagaaccagcccaccaaguucacccccaucggccucaacgaggucgccaacggccaccgcuucgagcaguggacccucccccgcuacuccggcgcccucacccucaacaugaaccucgcccccgccgucgccccccucuuccccggcgagcgccuccucuucuuccgcuccuacgucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuuccgcuucgacuga

SEQ ID NO: 17391 - RNA, 1551 nt, Artificial Sequence
  derived and/or modified sequence opt2 from VP1__Norovirus_and/or_Norovirus-like__AY549156
augaagaugaccgaccgcgacaccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacaaccucucccacucccgcgucauggagcccaucgcccagaugauguccucccgcaacuuccccgccuccguccaguuccagaacggccgcugcacccucuccggcgaccuccucggcaccacccccuccucccccgccgaccucggcgccuucgucggccuccgcgccgagcccggcucccgcgucgucgagcucucccagcccaaccaggaggacuuccacgccggcuccgcccccgcccccuucggcuuccccgacuucuccgacugcuccgucaccuucgucgucgccuccgccaccaccgucggcgagcgcaccgucaacacccgcucccuccagaacuucacccccgcccucggccacaucaccuucgacgaggaggcccccgccgaccucuuccgcgcccacuuccgcaaccucugggagcccaccgagcacuccuucuggcgcauccccgacuaccgcgccgacguccucggcuccgacuucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgcccccgaccaggccacccuccccgucgacggcaucuucaaguucgucuccugggucuccuccuacuaccagcuccgccccgucggcaacgccuccgccggccgccgccucuga

SEQ ID NO: 17392 - RNA, 1551 nt, Artificial Sequence
  derived and/or modified sequence opt2 from VP1__Norovirus_and/or_Norovirus-like__AY549163
augaagaugaccgaccgcgacaccaucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuacggcgccgaccccuucgucgucaccggccgcguccucaccugccccucccccaacuucuccuucuucuuccucgucccccccaccgucgaggagcgcgagacccccuucacccuccccaaccuccccgucaacaaccucucccacucccgcgucauggagcccaucgcccagaugauguccucccgcaacuuccccgccuccguccaguuccagaacggccgcugcacccucuccggcgaccuccucggcaccacccccuccucccccgccgaccucggcgccuucgucggccuccgcgccgagcccggcucccgcgucgucgagcucucccagcccaaccaggaggacuuccacgccggcuccgcccccgcccccuucggcuuccccgacuucuccgacugcuccgucaccuucgucgucgccuccgccaccaccgucggcgagcgcaccgucaacacccgcucccuccagaacuucacccccgcccucggccacaucaccuucgacgaggaggcccccgccgaccucuuccgcgcccacuuccgcaaccucugggagcccaccgagcacuccuucuggcgcauccccgacuaccgcgccgacguccucggcuccgacuucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccauccuccccgucgacggcaucuucaaguucgucuccugggucuccuucuacuaccagcuccgccccgucggcaacgccuccgucggccgccgccucuga

SEQ ID NO: 17393 - RNA, 1551 nt, Artificial Sequence
  derived and/or modified sequence opt2 from VP1__Norovirus_and/or_Norovirus-like__AY549159
augaagaugaccgaccgcgacaccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagacccccuucacccuccccaaccuccccgucaacaaccucucccacucccgcgucauggagcccaucgcccagaugauguccucccgcaacuuccccgccuccguccaguuccagaacggccgcugcacccucuccggcgaccuccucggcaccacccccuccucccccgccgaccucggcgccuucgucggccuccgcgccgagcccggcucccgcgucgucgagcucucccagcccaaccaggaggacuuccacgccggcuccgcccccgcccccuucggcuuccccgacuucuccgacugcuccgucaccuucgucgucgccuccgccaccaccgucggcgagcgcaccgucaacgcccgcucccuccagaacuucacccccgcccucggccacaucaccuucgacgaggaggcccccgccgaccucuuccgcgcccaccuccgcaaccucugggagcccaccgagcacuccuucuggcgcauccccgacuaccgcgccgacguccucggcuccgacuucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucucccccaacaccggccgcguccucuucgaggccaagcucuacgccaacggcuuccucaccgucaaccucggcgccuccgaccaggccacccuccccgucgacggcaucuucaaguucgucuccugggucuccuucuacuaccagcuccgccccgucggcaacgccuccgucggccgccgccucuga

SEQ ID NO: 17394 - RNA, 1551 nt, Artificial Sequence
  derived and/or modified sequence opt2 from VP1__Norovirus_and/or_Norovirus-like__AY549166
augaagaugaccgaccgcgacaccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagacccccuucacccuccccaaccuccccgucaacaaccucucccacucccgcgucauggagcccaucgcccagaugauguccucccgcaacuuccccgccuccguccaguuccagaacggccgcugcacccucuccggcgaccuccucggcaccacccccuccucccccgccgaccucggcgccuucgucggccuccgcgccgagcccggcucccgcgucgucgagcucucccagcccaaccaggaggacuuccacgccggcuccgcccccgcccccuucggcuuccccgacuucuccgacugcuccgucaccuucgucgucgccuccgccaccaccgucggcgagcgcaccgucaacacccgcucccuccagaacuucacccccgcccucggccacaucaccuucgacgaggaggcccccgccgaccucuuccgcgcccacuuccgcaaccucugggagcccaccgagcacuccuucuggcgcauccccgacuaccgcgccgacguccucggcuccgacuucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccuccucgaggccaagcucugcgccaacggcuuccucaccgucaaccucggcgccuccgaccaggccacccuccccgucgacggcaucuucaaguucgucuccugggucuccuucuacuaccagcuccgccccgucggcaacgccuccgucggccgccgccucuga

SEQ ID NO: 17395 - RNA, 1551 nt, Artificial Sequence
  derived and/or modified sequence opt2 from VP1__Norovirus_and/or_Norovirus-like__AF320113
augaagaugaccgaccgcgacaucaucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccuccccugccccucccccaacuucuccuucuucuuccucgucccccccaccgucgaggagcgcgagccccccuucacccuccccaaccuccccgucaacaaccucucccacucccgcgucauggagcccaucgcccagaugauguccucccgcaccuuccccgccuccguccaguuccagaacggccgcugcacccucuccggcgaccuccucggcaccacccccuccucccccuccgaccucggcgccuucgucggccucaucgccgagcccggcucccgcgucgucgagcucuuccagcccaaccaggaggacuuccacgccggcuccgcccccgccccccucggcuuccccgacuucuccgacugcucccucaccuucgucgucgccuccgccaccaccgucggcgagcgcaccgucaacgcccgcucccuccagaacuucacccccgcccucggccacaucaccuucgacgaggaggcccccgccgaccucuuccgcgcccaccuccgcaaccucugggaccccaccgagcacuccuucuggcgcauccccgacuaccgcgccgacguccucggcuccgagcucgcccccuccgucuccgcccccggcgucggcgagacccuccucuucuucaccugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgucaacggcuuccucaccgucaaccucggcgccuccgaccaggccacccuccccgucgacggcaucuucaaguucgucuccugggucuccuucuacuaccagcuccgccccgucggcaacgccuccgucggccgccgccucuga

SEQ ID NO: 17396 - RNA, 1551 nt, Artificial Sequence
  derived and/or modified sequence opt2 from VP1__Norovirus_and/or_Norovirus-like__AY549153
augaagaugaccgaccgcgacaccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacaaccucucccacucccgcgucauggagcccaucgcccagaugauguccucccgcuccucccccgccuccauccaguuccagaacggccgcugcacccucuccggcgaccuccucggcaccacccccuccucccccgccgaccucggcgccuucgucggccuccgcgccgagcccggcucccacgucgucgagcucucccagcccaaccaggaggacuuccacgccggcuccgcccccgcccccuucggcuuccccgacuucuccgacugcuccgucaccuucgucgucgccuccgccaccaucgucgagcagcgcaccgucaacgcccgcucccuccagaacuucacccccgcccucggccacaucaccuucgacgaggaggcccccgccgaccucuuccgcgcccgcuuccgcaacgucugggaccccaccgagcacuccuucuggcgcauccccgacuaccgcgccgacguccucggcuccgacuucgcccccuccgucuccgcccccggcgucggcgagacccuccucuucuucaugugcaacgucccccacuccaacggcgccaaccccaaccccugccccugccuccucccccaggaguggaucacccacuucgucuccgagcgcgccgcccuccagggcgacgucgcccuccucaacuacaucaaccccaacaccggccgcgucuccuucgaggccaagcucuacgccaacggcuuccucaccgucaaccucggcgccuccgaccgcaccacccuccccgucgacggcaucuucaaguucgucuccugggucuccuucuacuaccagcuccgccccgucggcaacgccuccgucggccgccgccucuga

SEQ ID NO: 17397 - RNA, 1551 nt, Artificial Sequence
  derived and/or modified sequence opt2 from VP1__Norovirus_and/or_Norovirus-like__AY549157
augaagaugaccgaccgcgacaccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacaaccucucccacucccgcgucauggagcccaucgcccagaugauguccucccgcaacuuccccgccuccguccaguuccagaacggccgccgcacccucuccggcgaccuccucggcaccacccccuccucccccgccgaccucggcgccuucgucggccuccgcgccgagcccggcucccgcgucgucgagcucucccagcccaaccaggaggacuuccacgccggcuccgcccccgcccccuucggcuuccccgacuucuccgacugcuccgucaccuucgucgucgccuccgccaccaccgucggcgagcgcaccgucaacacccgcucccuccagaacuucacccccgcccucggccacaucaccuucgacgaggaggcccccgccgaccucuuccgcgcccacuuccgcaaccucugggagcccaccgagcacuccuucuggcgcauccccgacuaccgcgccgacguccucggcuccgacuucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccacccuccccgucgacggcaucuucaaguucgucuccugggucuccuucuacuaccagcuccgccccgucggcaacgccuccgucggccgccgccucuga

SEQ ID NO: 17398 - RNA, 1551 nt, Artificial Sequence
  derived and/or modified sequence opt2 from VP1__Norovirus_and/or_Norovirus-like__AY549158
augaagaugaccgaccgcgacgccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacaaccccucccacucccgcgucauggagcccaucgcccagaugauguccucccgcaacuuccccgccuccguccaguuccagaacggccgcugcacccucuccggcgaccuccucggcaccacccccuccucccccgccgaccucggcgccuucgucggccuccgcgccgagcccggcucccgcgucgucgagcucucccagcccaaccaggaggacuuccacgccggcuccgcccccgcccccuucggcuuccccgacuucuccgacugcuccgucaccuucgucgucgccuccgccaccaccgucggcgagcgcaccgucaacacccgcucccuccagaacuucacccccgcccucggccacaucaccuucgacgaggaggcccccgccgaccucuuccgcgcccacuuccgcaaccucugggagcccaccgagcacuccuucuggcgcauccccgacuaccgcgccgacguccucggcuccgacuucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcucccucaccgucaaccucggcgccuccgaccaggccacccuccccgucgacggcaucuucaaguucgucuccugggucuccuucuacuaccagcuccgccccgucggcaacgccuccgucggccgccgccucuga

SEQ ID NO: 17399 - RNA, 1551 nt, Artificial Sequence
  derived and/or modified sequence opt2 from VP1__Norovirus_and/or_Norovirus-like__AY549165
augaagaugaccgaccgcgacaccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacgccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucggcccccccaccgucgaggagcgcgagccccucuucacccuccccaaccuccccgucaacaaccucucccacucccgcgucauggagcccaucgcccagaugauguccucccgcuccuuccccgccuccguccaguuccagaacggccgcugcacccucuccggcgaccuccucggcaccacccccuccucccccgccgaccucggcgccuucgucggccuccgcgccgagcccggcucccacgucgucgagcucucccagcccaaccaggaggacuuccacgccggcuccgcccccgcccccuucggcuuccccgacuucuccggcugcuccgucaccuucgucgucgccuccgccaccaucgucgagcagcgcaccgucaacacccgcucccuccagaacuucacccccgcccucggccacaucaccuucgacgaggaggcccccgccgaccucuuccgcgcccgcuuccgcaacgucugggaccccaccgagcacuccuucuggcgcauccccgacuaccgcgccgacguccucggcuccgacuucgcccccuccgucuccgcccccggcggcggcgagacccuccucuucuucaugugcaacgucccccacuccaacggcgccaaccccaaccccugccccugccuccucccccaggaguggaucacccacuucgucuccgagcgcgccgcccuccagggcgacgucgcccuccucaacuacaucaaccccaacaccggccgcguccucuucgaggccaagcucuacgccaacggcuuccucaccgucaaccucggcgccuccgaccaggccgcccuccccgucgacggcaucuucaaguucgucuccugggucuccuucuacuaccagcuccgccccgucggcaacgccuccgucggccgccgccucuga

SEQ ID NO: 17400 - RNA, 1551 nt, Artificial Sequence
  derived and/or modified sequence opt2 from VP1__Norovirus_and/or_Norovirus-like__AY549167
augaagaugaccgaccgcgacaccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccucuucacccuccccaaccuccccgucaacaaccucucccacucccgcgucauggagcccaucgcccagaugauguccucccgcggcuuccccgccuccguccaguuccagaacggccgcugcacccucuccggcgaccuccucggcaccacccccuccucccccgccgaccucggcgccuucgucggccuccgcgccgagcccggcucccacgucgucgagcucucccagcccaaccaggaggacuuccacgccggcuccgcccccgcccccuucggcuuccccgacuucuccgacugcuccgucaccuucgucgucgccuccgccaccaucgucgagcagcgcaccgucaacgcccgcucccuccagaacuucacccccgcccucggccacaucaccuucgacgaggaggcccccgccgaccucuuccgcgcccgcuuccgcaacgucugggaccccaccgagcacuccuucuggcgcauccccgacuaccgcgccgacguccucggcuccgacuucgcccccuccgucuccgcccccggcgucggcgagacccuccucuucuucaugugcaacgucccccacuccuccggcgccaaccccaaccccugccccugccuccucccccaggaguggaucacccacuucgucuccgagcgcgccgcccuccagggcgacgucgcccuccucaacuacaucaaccccaacaccggccgcguccucuucgaggccaagcucuacgccaacggcuuccucaccgucaaccucggcgccuccgaccaggccacccuccccgucgacggcaucuucaaguucgucuccugggucuccuucuacuaccagcuccgccccgucggcaacgccuccgucggccgccgccucuga

SEQ ID NO: 17401 - RNA, 1551 nt, Artificial Sequence
  derived and/or modified sequence opt2 from VP1__Norovirus_and/or_Norovirus-like__AY549154
augaagaugaccgaccgcgacaccgucgaccccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccacauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccuccgccgaccccuucgucgucaccggccgcguccucaccugccccaaccccaacuucuccuucuucuuccucgucccccccaccgucgaggagcgcgagccccccuucacccuccccaaccuccccgucaacaaccucucccacucccgcgucauggagcccaucgcccagaugauguccucccgcaacuuccccgccuccguccaguuccagaacggccgcugcacccucuccggcgaccuccucggcaccacccccuccucccccgccgaccucggcgccuucgucggccuccgcgccgagcccggcucccgcgucgucgagcucucccagcccaaccaggaggacuuccacgccggcuccgcccccgcccccuucggcuuccccgacuucuccgacugcuccgucaccuucgucgucgccuccgccaccaccgucggcgagcgcaccgucaacacccgcucccuccagaacuucacccccgcccucggccacaucaccuucgacgaggaggcccccgccgaccucuuccgcgcccacuuccgcaaccucugggagcccaccgagcacuccuucuggcgcauccccgacuaccgcgccgacguccucggcuccgacuucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccacccuccccgucgacggcaucuucaaguucgucuccugggucuccuucuacuaccagcuccgccccgucggcaacgccuccgucggccgccgccucuga

SEQ ID NO: 17402 - RNA, 1551 nt, Artificial Sequence
  derived and/or modified sequence opt2 from VP1__Norovirus_and/or_Norovirus-like__AY549155
augaagaugaccgaccgcgacaccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcgucuacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugaagcucaugggcaugcucuacaccccccuccgcgccaacuccuccgccaaccccuucgucgucaccggccgcguccucaccugccccucccccaacuucuccuucuucuuccucgucccccccaccgucgaggagcgcgagccccccuucacccuccccaaccuccccgucaacaaccucucccacucccaggucauggagcccaucgcccagaugauguccucccgcaacuuccccgccuccguccaguuccagaacggccgcugcacccucuccggcgaccuccucggcaccacccccuccucccccgccgaccucggcgccuucgucggccuccgcgccgagcccggcucccgcgucgucgagcucucccagcccaaccaggaggacuuccacgccggcuccgcccccgcccccuucggcuuccccgacuucuccgacugcuccgucaccuucgucgucgccuccgccaccaccgucggcgagcgcaccgucaacgcccgcacccuccagaacuucacccccgcccucggccacaucaccuucgacgaggaggcccccgccgaccucuuccgcgcccacuuccgcaaccucugggagcccaccgagcacuccuucuggcgcauccccgacuaccgcgccgacguccucggcuccgacuucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccacccuccccgucgacggcaucuucaaguucgucuccugggucuccuucuacuaccagcuccgccccgucggcaacgccuccgucggccgccgccucuga

SEQ ID NO: 17403 - RNA, 1551 nt, Artificial Sequence
  derived and/or modified sequence opt2 from VP1__Norovirus_and/or_Norovirus-like__AF320625
augaagaugaccgaccgcgacaucaucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgucuucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagcccuccuucacccuccccaaccuccccgucaacaaccucucccacucccgcgucauggagcccaucgcccagaugauguccucccgcaccuuccccgccuccguccaguuccagaacggccgcugcacccucuccggcgaccuccucggcaccacccccuccucccccuccgaccucggcgccuucgucggccucaucgccgagcccggcucccgcaucgucgagcucucccagcccaaccaggaggacuuccacgccggcuccgcccccgcccccuucggcuuccccgacuucuccgacugcucccucaccuucgucgucgccuccgccaccaccgucggcgagcgcaccgucaacgcccgcucccuccagaacuucacccccgcccucggccacaucaccuucgacgaggaggcccccgccgaccucuuccgcgcccaccuccgcaaccucugggaccccaccgagcacuccuucuggcgcauccccgacuaccgcgccgacguccucggcuccgaguucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccacccuccccgucgacggcaucuucaaguucgucuccugggucuccuucuacuaccagcuccgccccgucggcaacgccuccgucggccgccgccucuga

SEQ ID NO: 17404 - RNA, 1551 nt, Artificial Sequence
  derived and/or modified sequence opt2 from VP1__Norovirus_and/or_Norovirus-like__AY274820
augaagaugaccgaccgcgacaccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccacggcgaguucaccaucucccccaacaacaaccccggcgagguccucuucgagcucaagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccaagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacaaccucucccacucccgcgucauggagcccaucgcccagaugauguccucccgcaacuuccccgccuccguccaguuccagaacggccgcugcacccucuccggcgaccuccucggcaccacccccuccucccccgccgaccucggcgccuucgucggccuccgcgccgagcccggcucccgcgucgucgagcucucccagcccaaccaggaggacuuccacgccggcuccgcccccgcccccuucggcuuccccgacuucuccgagugcuccgucaccuucauggucgccuccgccaccaccgucggcgagcgcaccgucaacacccgcucccuccagaacuucacccccgcccucggccacaucaccuucgacgaggaggcccccgccgaccucuuccgcgcccgcuuccgcaaccucugggagcccaccgagcacuccuucuggcgcauccccgacuaccgcgccgacguccucggcuccgaguucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccucccuccccgucgacggcaucuucaaguucgucuccugggucuccuucuacuaccagcuccgccccgucggcaacgccuccgucggccgccgccucuga

SEQ ID NO: 17405 - RNA, 1551 nt, Artificial Sequence
  derived and/or modified sequence opt2 from VP1__Norovirus_and/or_Norovirus-like__AF542083
augaagaugaccgaccgcgacaccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagguccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacaaccucucccacucccgcgucauggagcccaucgcccagaugauguccucccgcaacuuccccgccuccguccaguuccagaacggccgcugcacccucuccggcgaccuccucggcaccacccccuccucccccgccgaccucggcgccuucgucggccuccgcgccgagcccggcucccgcgucgucgagcucucccagcccaaccaggaggacuuccacgucggcuccgcccccgccccccucggcuuccccgacuucuccgacugcuccgucaccuucgucgucgccuccgccaccaccgucggcgagcgcaccgucaacacccgcucccuccagaacuucacccccgcccucggccacaucaccuucgacgaggaggcccccgccgaccucuuccgcgcccacuuccgcaaccucugggagcccaccgagcacuccuucuggcgcauccccgacuaccgcgccgacguccucggcuccgacuucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaaccucuacgccaacggcuuccucaccgucaaccucggcgccuccgaccaggccacccuccccgucgacggcaucuucaaguucgucuccugggucuccuucuacuaccagcuccgccccgucggcaacgccuccgucggccgccgccucuga

SEQ ID NO: 17406 - RNA, 1551 nt, Artificial Sequence
  derived and/or modified sequence opt2 from VP1__Norovirus_and/or_Norovirus-like__EU794907
augaagaugaccgaccgcgacgucaccgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacaaccucucccacucccgcgucauggagcccaucgcccagaugauguccucccgcaacuuccccgccuccguccaguuccagaacggccgcugcacccucuccggcgaccuccucggcaccacccccuccucccccuccgaccucggcgccuucgucggccucaucgccgagcccggcucccgcgucgucgagcucucccagcccaaccaggaggacuuccacgccggcuccgcccccgcccccuucggcuuccccgacuucuccgacugcucccucaccuucgucgucgccuccgccaccaccgucggcgagcgcaccgucaacgcccgcuccccccagaacuucacccccgcccucggccacaucaccuucgacgaggaggcccccgccgaccucuuccgcgcccaccuccgcaaccucugggaccccaccgagcacuccuucuggcgcauccccgacuaccgcgccgacguccucggcuccgaguucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccacccuccccgucgacggcaucuucaaguucgucuccugggucuccuucuacuaccagcuccgccccgucggcaacgccuccgucggccgccgccucuga

SEQ ID NO: 17407 - RNA, 1551 nt, Artificial Sequence
  derived and/or modified sequence opt2 from VP1__Norovirus_and/or_Norovirus-like__AY126474
augaagaugaccgaccgcgacaccaucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacaaccucucccacucccgcgucauggagcccaucgcccagaugauguccucccgcaacuuccccgccuccguccaguuccagaacggccgcugcacccucuccggcgaccuccucggcaccacccccuccucccccgccgaccucggcgccuucgucggccucaucgccgagcccggcucccgcgucgucgagcucucccagcccaaccaggaggacuuccacgccggcuccgcccccgcccccuucggcuuccccgacuucuccgagugcucccucaccuucgucgucgccuccgccaccaccgucggcgagcgcaccgucaacacccgcucccuccagaacuucacccccgcccucggccacaucaccuucgacgaggaggcccccgccgaccucuuccgcgcccaccuccgcaaccucugggaccccaccgagcacuccuucuggcgcauccccgacuaccgcgccgacguccucggcuccgaguucgcccccuccgucuccgcccccggcgucggcgagacccuccucuucuucaugugcaacgucccccgccucaacggcgccaaccccggccucugccccugccuccucccccaggaguggaucacccacuucgucuccgagcgcgccgcccuccaguccgacgucgcccuccucaacuacgucaaccccaacaccggccgcguccucuucgagugcaagcucuacgccaacggcuuccucaccgucaaccucggcgccuccgaccaggccacccuccccgucgacggcaucuucaaguucgucuccugggucuccuucuacuaccagcuccgccccgucggcaacgccuccgucggccgccgccucuga

SEQ ID NO: 17408 - RNA, 1551 nt, Artificial Sequence
  derived and/or modified sequence opt2 from VP1__Norovirus_and/or_Norovirus-like__JX145650
augaagaugaccgaccgcgacaucgucgacuccgcccccgcccucggccagguccucccccccgaggucgaggccuccguccccgucgagcccaccgccggcgcccccgucgccgccuccaccgccggccgcgucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgacaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacucccucucccacucccgcgucauggagcccaucgcccagaugauguccucccgcuccuuccccgccuccguccaguuccagaacggccgcugcacccucuccggcgaccuccucggcaccacccccuccucccccgccgaccucggcgccuucgucggccucaucgccgagcccggcucccgcgucgucgagcucucccagcccaaccaggaggacuuccacgccggcuccgcccccgcccccuucggcuuccccgacuucuccgagugcuccgucaccuucgucgucgccuccgccaccaccgucggcgagcgcaccgucaacgcccgcaacccccagaacuucacccccgcccucggccacaucaccuucgacgaggaggcccccgccgaccucuuccgcgcccgcuuccgcaaccucugggagcccaccgagcacuccuucuggcgcauccccgacuaccgcgccgacguccucggcuccgacuucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccauccuccccgucgacggcaucuucaaguucgucuccugggucuccuucuacuaccagcuccgccccgucggcaacaucuccgucggccgccgccucuga

SEQ ID NO: 17409 - RNA, 1548 nt, Artificial Sequence
  derived and/or modified sequence opt2 from VP1__Norovirus_and/or_Norovirus-like__AY549161
augaagaugaccgaccgcgacaccaccgacuccgcccccgcccucggccagguccucccccccgaggucgaggccuccguccccgucgagcccaccgccggcgcccccgucgccgccgccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacgccuccuaccucacccccucccaggccacccaguucccccacguccucaucgacguccgcgcccccgagcccgucgagaugccccucgaggacguccgcaacauccucuuccaccagggccccgacucccgcaugaagcucaugggcaugcucuacaccccccuccgcgccaacuccggcgccgaccccuucgucgucaccggccgcguccucaccugccccucccccaacuucuccuucuucuuccucgucccccccaccgucgaggagcgcgaggcccccuucacccuccccaaccuccccgucaacucccucucccacucccgcuacgucggccccaucaugcagaugauguccucccgcaccuuccccgccuccguccaguuccagaacggccgcugcacccucuccggcgaccuccucggcaccacccccuccuccuccgccgaccucggcgccuucgucggccucaucgccgaggccggcucccgcgucgucgagcucucccagcccaaccaggaggacuuccacgccggcuccgcccccgccccccucggcuuccccgacuucuccgacugcucccucaccuucgucgucgccucccucaccaccgucggcgagcgcaccgucaacgcccgcucccuccagaacuucacccccgcccucggccacgucaccuucgacgaggaggcccccgccgaccucuuccgcgcccgccuccgcaaccucugggaccccaccgagcacuccgucuggcgcauccccgacuaccgcgccgacguccucggcuccgaguucgcccccuccgucuccgcccccggcgucggcgagacccuccucuucuucaugugcaacgucccccaccagaccggcgccaaccccaaccccugccccugccuccucccccaggaguggaucacccacuucgucuccgagcgcgccgcccuccaguccgaggucgcccuccucaacuacgucaaccccaacaccggccgcguccucuucgagugcaagcucuacgccaacggcuuccucaccgucaaccucggcgccuccgaccaggucucccuccccgucgacggcaucuucaaguucgucuccugggucuccuucuacuaccagcuccgccccgucggcaacaccggcgucggccgccgcuga

SEQ ID NO: 17410 - RNA, 1548 nt, Artificial Sequence
  derived and/or modified sequence opt2 from VP1__Norovirus_and/or_Norovirus-like__AY549164
augaagaugaccgaccgcgacgccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucggcccccccaccgucgaggagcgcgagccccucuucacccuccccaaccuccccgucaacaaccucucccacucccgcgucauggagcccaucgcccagaugauguccucccgcuccuuccccgccuccguccaguuccagaacggccgcugcacccucuccggcgaccuccucggcaccacccccuccucccccgccgaccucggcgccuucgucggccuccgcgccgagcccggcucccgcgucgucgagcucucccagcccaaccaggaggacuuccacgccggcuccgcccccgcccccuucggcuuccccgacuucuccgacugcuccgucaccuucgucgucgccaacgccaccaccguccaggagugcaccgucaacacccgcaacccccagaacuucacccccgcccucggccacaucaccuucgacgaggaggcccccgccgaccucuuccgcgcccgcuuccgcaaccucugggaccccaccgagcacuccuucuggcgcauccccgacuaccgcgccgagguccucggcuccgacuucgcccccuccgucuccgcccccggcgucggcgagacccuccucuucuucaugugcaacgucccccgcuccaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccacccuccccgucgacggcaucuucaaguucgucuccugggucuccuucuacuaccagcuccgccccgucggcaacaccuccgucggccgccgcuga

SEQ ID NO: 17411 - RNA, 1548 nt, Artificial Sequence
  derived and/or modified sequence opt2 from VP1__Norovirus_and/or_Norovirus-like__AY126476
augaagaugaccgaccgcgacaccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacaaccucucccacucccgcgucauggagcccaucgcccagaugauguccucccgcuccuuccccgccuccguccaguuccagaacggccgcugcacccucuccggcgaccuccucggcaccacccccuccucccccgccgaccucggcgccuucgucggccuccgcgccgagcccggcucccgcgucgucgagcucucccagcccaaccaggaggacuuccacgccggcuccgcccccgcccccuucggcuuccccgacuucuccgacugcuccgucaccuucgucgucgccuccgccaccaccguccaggagugcaccgucaacacccgcaaccuccagaacuucacccccgcccucggccacaucaccuucgacgaggaggcccccgccgaccucuuccgcgcccgcuuccgcaaccucugggaccccaccgagcacucccucuggcgcauccccgacuaccgcgccgagguccucggcuccgacuucgcccccuccgucuccgcccccggcgucggcgagacccuccucuucuucaugugcaacgucccccgcuccaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccuccggcuuccucaccgucaaccucggcgccuccgaccaggccacccuccccgucgacggcaucuucaaguucgucuccugggucuccuucuacuaccagcuccgccccgucggcaacaccuccgucggccgccgcuga

SEQ ID NO: 17412 - RNA, 1548 nt, Artificial Sequence
  derived and/or modified sequence opt2 from VP1__Norovirus_and/or_Norovirus-like__EU794905
augaagaugaccgaccgcgacaccaucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagacccccuucacccuccccaaccuccccgucaacucccucucccacucccgcgccauggagcccaucgcccagaugauguccucccgcaacuuccccgccuccguccaguuccagaacggccgcugcacccucuccggcgaccuccucggcaccacccccuccucccccgccgacgucggcaccuucgucggccucaucgccgagcccggcucccacgucgucgagcucucccagcccaaccaggaggacuuccacgccggcuccgcccccgcccccuucggcuuccccgacuucuccgacugcucccucaccuucgucgucgccuccgccuccaccgucggcgagcgcaccgucaacacccgcuccccccagaacuucacccccgcccucggccacaucaccuucgacgaggaggcccccgccgaccucuuccgcgcccaccuccgcaaccucugggaccccaccgagcacuccuucuggcgcauccccgacuaccgcgccgacguccucggcggcgaguucgcccccuccgucuccgcccccggcgucggcgagacccuccucuucuucaugugcaacgucccccgcuccaacggcgccaaccccaaccccugccccugccuccucccccaggaguggaucacccacuucgucuccgagcgcgccgcccuccaguccgacgucgcccuccucaacuacaucaaccccaacaccggccgcguccucuucgagugcaagcucuacgccaacggcuuccucaccgucaaccucggcgccuccgaccaggccacccuccccgucgacggcaucuucaaguucgucuccugggucuccuucuacuaccagcuccgccccgucggcaacaucggcgucggccgccgcuga

SEQ ID NO: 17413 - RNA, 1548 nt, Artificial Sequence
  derived and/or modified sequence opt2 from VP1__Norovirus_and/or_Norovirus-like__EU794906
augaagaugaccgaccgcgacaccaucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagacccccuucacccuccccaaccuccccgucaacucccucucccacucccgcgucauggagcccaucgcccagaugauguccucccgcaacuuccccgccuccguccaguuccagaacggccgcugcacccucuccggcgaccuccucggcaccacccccuccucccccgccgaccucggcaccuucgucggccucaucgccgagcccggcucccacgucgccgagcucucccagcccaaccaggaggacuuccacgccggcuccgcccccgcccccuucggcuuccccgacuucuccgagugcucccucaccuucgucgucgccuccgccuccaccgucggcgagcgcaccgucaacacccgcucccuccagaacuucacccccgcccucggccacaucaccuucgacgaggaggcccccgccgaccucuuccgcgcccaccuccgcaaccucugggaccccaccgagcacuccuucuggcgcauccccgacuaccgcgccgacguccucggcggcgaguucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacaucaaccccaacaccggccgcguccucuucgagugcaagcucuacgucaacggcuuccucaccgucaaccucggcgccuccgaccaggccacccuccccgucgacggcaucuucaaguucgucuccugggucuccuucuacuaccagcuccgccccgucggcaacaucggcgucggccgccgcuga

SEQ ID NO: 17414 - RNA, 1548 nt, Artificial Sequence
  derived and/or modified sequence opt2 from VP1__Norovirus_and/or_Norovirus-like__AY126475
augaagaugaccgaccgcgacaccgccgaccccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcguccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacaaccucucccacucccgcgucauggagcccaucgcccagaugauguccucccgcuccuuccccgccuccguccaguuccagaacggccgcugcacccucuccggcgaccuccucggcaccacccccuccucccccgccgaccucggcgccuucgucggccucaucgccgagcccggcucccgcgucgucgagcucuuccagcccaaccaggaggacuuccacgccggcuccgcccccgcccccuucggcuuccccgacuucuccgagugcuccgucaccuucgucgucuccuccgccaccaccgucggcgagcgcaccgucaacgcccgcaaccagcagaacuucacccccgcccucggccacaucaccuucgacgaggaggcccccgccgaccucuuccgcgccugcuuccgcaaccucugggagcccaccgagcacuccuucuggcgcauccccgacuaccgcgccgacguccucggcuccgacuucgcccccuccgucuccgcccccggcgucggcgagacccuccucuucuucaugugcaacgucccccgccucaacggcgucaaccccggccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccacccuccccgucgacggcaucuucaaguucgucuccugggucuccuucuacuaccagcuccgccccgucggcaacaccuccgucggccgccgcuga

SEQ ID NO: 17415 - RNA, 1548 nt, Artificial Sequence
  derived and/or modified sequence opt2 from VP1__Norovirus_and/or_Norovirus-like__AF542084
augaagaugaccgaccgcgacaccgucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccucuucacccuccccaaccuccccgucaacaaccucucccacucccgcgucauggagcccaucgcccagaugauguccucccgcaacuuccccgccuccguccaguuccagaacggccgcugcacccucuccggcgaccuccucggcaccacccccuccucccccgccgaccucggcgccuucgucggccuccgcgccgagcccggcucccgcgucgucgagcucucccagcccaaccaggaggacuuccacgccggcuccgcccccgccccccucggcuuccccgacuucuccgacugcuccgucaccuucgucgucgccaacgccaccaccguccaggagugcaccgucaacacccgcaacccccagaacuucacccccgcccucggccacaucaccuucgacgaggaggcccccgccgaccucuuccgcgcccacuuccgcaaccucugggaccccaccgagcacuccuucuggcgcauccccgacuaccgcgccgagguccucggcuccgacuucgcccccuccgucuccgcccccggcgucggcgagacccuccucuucuucaugugcaacgucccccgcuccaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccacccuccccgucgacggcaucuucaaguucgucuccugggucuccuucuacuaccagcuccgccccgucggcaacaccuccgucggccgccgcuga

SEQ ID NO: 17416 - RNA, 1536 nt, Artificial Sequence
  derived and/or modified sequence opt2 from VP1__Norovirus_and/or_Norovirus-like__KC695807
auggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgcuga

SEQ ID NO: 17417 - RNA, 807 nt, Artificial Sequence
  derived and/or modified sequence opt2 from VP2_capsid_protein__Norovirus__AGL98415
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgacgccacccacaagcuccagcagggccucaugcagaucaagcaggccguccuccucgagggcggcuucuccgccgccgacgccgcccgcggcgccaucaacgcccccaugaccaaggcccucgacugguccggcacccgcuacugggcccccgaggcccgcgucaccaccuacaacgccggccacuucucccccucccagcccucccgcgcccccuccggccgcaucaacuccggcacccccacccccgcccgcaacucccucaacucccccgccaccuccuccgucgccaccuccguccacuccaaccagaccgccuccacccgcaucggcuccuccgccggcuccggcaccuccgucuccucccuccccuccaccucccgcacccgcaacugggucgaggaccagaaccgcuccgucucccccuucaugcgcggcgcccucaacaccuccuucgucaccccccccuccucccgcuccuccaaccaguccaccgucuccaccguccccaaggagauccucgacuccuggaccggcgccuucaacacccgccgccagccccucuucgcccacauccgccgccgcggcgagucccgcgucuga

SEQ ID NO: 17418 - RNA, 792 nt, Artificial Sequence
  derived and/or modified sequence opt2 from VP2_capsid_protein__Norovirus__AGL98417
auggccggcgccuucuucgccggccucgccuccgacguccucggcaccggccucggcucccucaucggcgccggcgccggcgccaucaaccagaaggucgaguacgagaacaaccgcaagcuccagcaggccuccuuccaguucuccuccgaccuccagcaggccuccuuccagcacgacaaggacaugcuccaggcccagaucaaggccacccagaagcuccagcacgaccucaugcgcgucaagcaggccguccuccucgagggcggcuucucccccaccgacgccgcccgcggcgccaucaacgcccccaugaccaagguccucgacugguccggcacccgcuacugggcccccggcgcccgcgucaccaccuccaacgccggccaguucuccuucucccagcccauccgcgagcccuccggccgcaccgcccccgcccgcucccccgccaaccgcgccuccuccgucuccgcccccuccuccacccucuccaaccagaccaccuccacccgccucggcaccuccgccggcuccggcgccuccgucuccggcuccuccuccgccucccgcguccgcuccugggucgagggccagaaccgcucccucucccccuucauggacggcgcccuccacaccuccuucgucaccccccccuccuccaaguccuccucccagggcaccgucuccaccguccccaaggagguccucgacuccuggaccggcgccuucaacacccaccgccagccccucuucgcccacguccgccgccagggcgagucccgcgucuga

SEQ ID NO: 17419 - RNA, 648 nt, Artificial Sequence
  derived and/or modified sequence opt2 from capsid_protein_VP2__Norovirus__AFI08232
auggcccaggccguccucggcgccaucgccgccaccgccgccggcuccgccgucggcgccggcauccaggccggcaccgaggccgcccuccagcaccagcgcuuccagcaggaccucacccuccaguccaacaccuucaagcacgacaaggagaugcucgccaugcaggucgaggccuccaccucccuccuccagaacucccucaacacccgcuacaaccuccucacccaggccggccucaccuccgccgacgccgcccgcgccgucgccggcgcccccgucacccgcgucgucgacuggaacggcacccgcaucgccgccccccucuccaccgccaccacccuccgcuccggcggcuucauguccauccccgucauguaccgcggcgccaagaccgagcagcagaagcucaccggcuucuccaaccccaacuacgagaccggcuccuccgucucccgcaccucccagugggucuccucccagaacuccaugcgcuccuccgucgcccccuuccaccccgacgcccuccgcaccaccugggucaccccccccggcuccuccuccaccuccaccgucuccuccgccuccuccaucccccgcuucuucaacaccgagcgccucccccucuucgccaacaacaagcgcuga

SEQ ID NO: 17420 - RNA, 807 nt, Artificial Sequence
  derived and/or modified sequence opt2 from capsid_protein_VP2__Norovirus__AFI08235
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcgcccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucaacuccuggaccggcgccuucaacacccgccgccagccccucuucgcccacauccgccgccagggcgagucccgcgucuga

SEQ ID NO: 17421 - RNA, 807 nt, Artificial Sequence
  derived and/or modified sequence opt2 from capsid_protein_VP2__Norovirus__AFI08238
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcgccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccugggccggcgccuucaacacccgccgccagccccucuucgcccacauccgccgccgcggcgagucccgcgucuga

SEQ ID NO: 17422 - RNA, 807 nt, Artificial Sequence
  derived and/or modified sequence opt2 from capsid_protein_VP2__Norovirus__AFI08241
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaccaacccccgcacccccacccccgcccgcggcuccuccuccgccuccuccaacgccuccaccgccaccuccauccucuccaaccagaccgccuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17423 - RNA, 807 nt, Artificial Sequence
  derived and/or modified sequence opt2 from capsid_protein_VP2__Norovirus__AFI08244
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccacccacaacgccggccgcuucuccaccccccagcccuccggcacccuccccggccgcaucaacccccgcacccccacccccgcccgcggcuccuccaacaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17424 - RNA, 807 nt, Artificial Sequence
  derived and/or modified sequence opt2 from capsid_protein_VP2__Norovirus__AFJ38520
auggccggccccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccacccagaagcuccagcagggccucaugaaggucaagcaggccguccuccucgagggcggcuucuccaccaccgacgccgcccgcggcgccaucaacgcccccaugaccaaggcccucgacugguccggcacccgcuacugggcccccgacgcccgcgccaccaccuacaacgccggccgcuucuccaccccccagccccucggcgcccuccccggccgcaucaacccccgcguccccgcccccgcccgcuccucccccuccucccucuccaacgcccccaccgccaccuccgucuacuccaaccagaccgucuccacccgccucggcuccuccgccggcuccggcgccggcgucuccucccuccccuccaccgcccgcacccgcuccugggucgaggaccagaaccgcaaccucucccccuucaugcgcggcgcccucaacaccuccuucgucaccccccccuccucccgcuccuccaaccagggcaccgucuccaccguccccaaggagauccucgacuccuggaccggcgccuucaacacccgccgccagccccucuucgcccacauccgcaagcgcggcgagucccgcgucuga

SEQ ID NO: 17425 - RNA, 765 nt, Artificial Sequence
  derived and/or modified sequence opt2 from capsid_protein_VP2__Norovirus__AFX71657
auggccggcgccuucaucgccggccucgccggcgacaugcucaccuccaccgucggcucccucgucaacgccggcgccuccgccaucaaccagaaggucgacuucgagaacaacaaguaccuccagaacgccuccuucaaccacgacaaggagaugcucaacgcccagaucgaggccaccaagcgccuccaggccgacaugaucgccaucaagcagggcguccucaccgccggcggcuucucccccaccgacgccgcccgcggcgccaucaacgcccccaucacccgcguccucgacugguccggcacccgcuacugggcccccaacgccaccuccaccaccuccauguccggcggcuucaccucccagaccguccaccgcaccacccccaacuucaagaccaaccaggcccccaaguccacccccuccuccggcuccuccguccgcuccaacuccacccagcucaccucccucuccucccacuccuccggcuccucccgcuccuccggcuccaccgucgucuccucccuccccuccuccaaccgcacccgcgacugggucaaccagcagaacuucaaccucgagccccacaugcccggcucccuccgcaccgccuucgucaccccccccuccuccaccgccuccaacuccgacaccgucuccaccguccccaaguccguccucgacuccuggaccuccgccuucaacacccgccgccagccccucuucgcccaccuccgccgccgcggcgaguccaacgucuga

SEQ ID NO: 17426 - RNA, 780 nt, Artificial Sequence
  derived and/or modified sequence opt2 from capsid_protein_VP2__Norovirus__AFX71660
auggccggcgccuucgucgccggccucgccggcgacguccucuccaacggccucuccucccucaucaacgccggcgccaacgccaucaaccagcgcgccgaguucgacuucaaccagcgccuccagcagaacuccuucaaccacgacaaggagaugcuccaggcccagauccaggccaccaagcagcuccaggccgacaugauggccaucaagcagggcguccucaccgccggcggcuucucccccaccgacgccgcccgcggcgccgucaacgcccccaugacccaggcccucgacuggaacggcacccgcuacugggcccccggcuccaugcgcaccaccuccuacuccggccgcuucaccuccaccgcccccgcccgccaggccgacuuccagcacacccagaaccgccccuccuccggcuccuccgucuccuccuacaccacccaguccucccgccccacccucaccaccaccaccggcuccucccacggcaccaccuccuccaacuccacccgcuccaccaaccucucccaguccaccgucucccgcgccaccucccgcaccuccgaguggguccgcgaccagaaccgcaaccucgagcccuacaugcacggcgcccuccagaccgccuucgucaccccccccuccucccgcgccuccgacggcaccgucuccaccguccccaagggcguccucgacuccuggacccccgccuucaacacccgccgccagccccucuucgcccaccuccgcaagcgcggcgagucccgcgucuga

SEQ ID NO: 17427 - RNA, 780 nt, Artificial Sequence
  derived and/or modified sequence opt2 from capsid_protein_VP2__Norovirus__AFX71666
auggccggcgccuucuucgccggccucgccggcgacgucgucuccaacggcaucggcucccucaucaacgccggcgccaacgccgucaaccagaaggucgaguacgacuucaacaagcagcuccagauggccuccuucaagcacgacaaggagaugcuccagucccagguccucgccaccaagcagcuccagcaggagaugaugaacauccgccagggcguccucaccgccggcggcuucucccccgccgacgccgcccgcggcgccgucaacgcccccaugaccaagauccucgacuggaacggcacccgcuacugggcccccaacuccaugaagaccaccuccuacuccggccaguucuccuccucccccguccaccgcccccccgccgccccccagcacaccgccccccccaaguccaagcuccagggcgacuccgucuccgucuacuccucccccuccaccgucuccucccaguccacccacuccaccguccucuccgccggcaccggcuccucccgcuccaccuccaccuccaccgccgccuccacccucucccgcaccuccgacuggguccgcggccagaacgagcgccucucccccuucauggacggcgcccuccagaccaccuucgucaccccccccuccuccaaggccuccuccaacggcaccgucuccaccguccccaaggccguccucgacuccuggacccccaccuucaacacccaccgccagccccucuucgcccaccuccgccgccgcggcgagucccagaucuga

SEQ ID NO: 17428 - RNA, 807 nt, Artificial Sequence
  derived and/or modified sequence opt2 from capsid_protein_VP2__Norovirus__AFX71669
auggccggcgccuucuucgccggccucgccuccgacguccucggcuccggccucggcucccucaucaacgccggcgccggcgucaucaaccagaaggucgacuucgagaacaaccgcaagcuccagcaggccuccuuccaguucuccuccaaccagcagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcgccucccccggccgcgccaaccuccgcgccaccguccccgcccgcggcuccuccuccaccuccuccaacuccuccaucgccaccuccgucuacuccaaccagaccaccuccacccgccucggcuccaccgccggcuccggcaccuccgucuccucccuccccuccaccgcccgcaccauguccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17429 - RNA, 807 nt, Artificial Sequence
  derived and/or modified sequence opt2 from capsid_protein_VP2__Norovirus__AFX81122
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaccaacccccgcacccccacccccgcccgcggcuccuccuccaccuccuccaacgccuccaccgccaccuccauccucuccaaccagaccgccuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17430 - RNA, 807 nt, Artificial Sequence
  derived and/or modified sequence opt2 from capsid_protein_VP2__Norovirus__AFX81125
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaucaugaaggccaagcaggccaugcuccucgagggcggcuucuccgagaccgacgccgcccgcggcgccaucaacgcccccaugaccaagguccucgacugguccggcacccgcuacugggcccccgacgcccgcaccgccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17431 - RNA, 807 nt, Artificial Sequence
  derived and/or modified sequence opt2 from capsid_protein_VP2__Norovirus__AFX81131
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggaggucaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17432 - RNA, 807 nt, Artificial Sequence
  derived and/or modified sequence opt2 from capsid_protein_VP2__Norovirus__AFX81134
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17433 - RNA, 807 nt, Artificial Sequence; identical to SEQ ID NO: 17432
  derived and/or modified sequence opt2 from capsid_protein_VP2__Norovirus__AFX81137

SEQ ID NO: 17434 - RNA, 807 nt, Artificial Sequence
  derived and/or modified sequence opt2 from capsid_protein_VP2__Norovirus__AFX81140
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccuccgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17435 - RNA, 807 nt, Artificial Sequence
  derived and/or modified sequence opt2 from capsid_protein_VP2__Norovirus__AFX81143
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcauccccacccccgcccgcggcuccuccuccaccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17436 - RNA, 807 nt, Artificial Sequence; identical to SEQ ID NO: 17432
  derived and/or modified sequence opt2 from capsid_protein_VP2__Norovirus__AFX81149

SEQ ID NO: 17437 - RNA, 807 nt, Artificial Sequence
  derived and/or modified sequence opt2 from capsid_protein_VP2__Norovirus__AFX81152
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcagggcaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17438 - RNA, 807 nt, Artificial Sequence
  derived and/or modified sequence opt2 from capsid_protein_VP2__Norovirus__AFX81155
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacguccccucccuccccuccaccgcccgcacccgcuccugggucgaggaccagaaccgcaaccucucccccuucaugcgcggcgcccagaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17439 - RNA, 807 nt, Artificial Sequence
  derived and/or modified sequence opt2 from capsid_protein_VP2__Norovirus__AFX81158
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccucacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17440 - RNA, 807 nt, Artificial Sequence
  derived and/or modified sequence opt2 from capsid_protein_VP2__Norovirus__AFX81164
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17441 - RNA, 807 nt, Artificial Sequence; identical to SEQ ID NO: 17432
  derived and/or modified sequence opt2 from capsid_protein_VP2__Norovirus__AFX81173

SEQ ID NO: 17442 - RNA, 807 nt, Artificial Sequence; identical to SEQ ID NO: 17432
  derived and/or modified sequence opt2 from capsid_protein_VP2__Norovirus__AFX81179

SEQ ID NO: 17443 - RNA, 807 nt, Artificial Sequence; identical to SEQ ID NO: 17440
  derived and/or modified sequence opt2 from capsid_protein_VP2__Norovirus__AFX81182

SEQ ID NO: 17444 - RNA, 807 nt, Artificial Sequence
  derived and/or modified sequence opt2 from capsid_protein_VP2__Norovirus__AFX81185
auggccggcgccuucuucgccggccucgccuccgacguccucggcuccggccucggcucccucaucaacgccggcgccggcgccaucaaccagaaggucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17445 - RNA, 807 nt, Artificial Sequence; identical to SEQ ID NO: 17432
  derived and/or modified sequence opt2 from capsid_protein_VP2__Norovirus__AFX81188

SEQ ID NO: 17446 - RNA, 807 nt, Artificial Sequence; identical to SEQ ID NO: 17432
  derived and/or modified sequence opt2 from capsid_protein_VP2__Norovirus__AFX81191

SEQ ID NO: 17447 - RNA, 807 nt, Artificial Sequence
  derived and/or modified sequence opt2 from capsid_protein_VP2__Norovirus__AFX81194
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcgucaacccccgcacccccacccccgcccgcggcuccuccuccaccuccuccaacgccuccaucgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17448 - RNA, 807 nt, Artificial Sequence; identical to SEQ ID NO: 17432
  derived and/or modified sequence opt2 from capsid_protein_VP2__Norovirus__AFX81197

SEQ ID NO: 17449 - RNA, 807 nt, Artificial Sequence
  derived and/or modified sequence opt2 from capsid_protein_VP2__Norovirus__AFX81200
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgucuccaccgccaccuccaucuaccucaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17450 - RNA, 807 nt, Artificial Sequence; identical to SEQ ID NO: 17440
  derived and/or modified sequence opt2 from capsid_protein_VP2__Norovirus__AFX81203

SEQ ID NO: 17451 - RNA, 807 nt, Artificial Sequence
  derived and/or modified sequence opt2 from capsid_protein_VP2__Norovirus__AFX81206
auggccggcgccuucuucgccggccucgccuccgacguccucggcuccggccucuccucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccgucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17452 - RNA, 807 nt, Artificial Sequence; identical to SEQ ID NO: 17440
  derived and/or modified sequence opt2 from capsid_protein_VP2__Norovirus__AFX81209

SEQ ID NO: 17453 - RNA, 807 nt, Artificial Sequence
  derived and/or modified sequence opt2 from capsid_protein_VP2__Norovirus__AFX81212
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccaccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17454 - RNA, 807 nt, Artificial Sequence
  derived and/or modified sequence opt2 from capsid_protein_VP2__Norovirus__AFX81215
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccgucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgcccccaucgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17455 - RNA, 807 nt, Artificial Sequence; identical to SEQ ID NO: 17440
  derived and/or modified sequence opt2 from capsid_protein_VP2__Norovirus__AFX81218

SEQ ID NO: 17456 - RNA, 807 nt, Artificial Sequence
  derived and/or modified sequence opt2 from capsid_protein_VP2__Norovirus__AFX81221
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcucccccuccaccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17457 - RNA, 807 nt, Artificial Sequence; identical to SEQ ID NO: 17440
  derived and/or modified sequence opt2 from capsid_protein_VP2__Norovirus__AFX81224

SEQ ID NO: 17458 - RNA, 807 nt, Artificial Sequence; identical to SEQ ID NO: 17440
  derived and/or modified sequence opt2 from capsid_protein_VP2__Norovirus__AFX81227

SEQ ID NO: 17459 - RNA, 807 nt, Artificial Sequence
  derived and/or modified sequence opt2 from capsid_protein_VP2__Norovirus__AFX81230
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccgaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccgcccccgcccgcggcuccuccuccaccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17460 - RNA, 807 nt, Artificial Sequence
  derived and/or modified sequence opt2 from capsid_protein_VP2__Norovirus__AFX81233
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgucuccaccgccaccuccaucuacuccaaccagaccuucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17461 - RNA, 807 nt, Artificial Sequence
  derived and/or modified sequence opt2 from capsid_protein_VP2__Norovirus__AFX81239
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgucuccaccgccaccuccaucuacuccaaccagaccgccuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17462 - RNA, 807 nt, Artificial Sequence
  derived and/or modified sequence opt2 from capsid_protein_VP2__Norovirus__AFX81242
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacuggaccggcacccgcuacugggcccccgacgcccgcaccaccaccuacaacgccggccgcuucuccaccccccagcccuccggcgcccuccccggccgcgccaaccuccgcgccaccguccccgcccgcggcuccuccuccaccuucuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17463 - RNA, 807 nt, Artificial Sequence
  derived and/or modified sequence opt2 from capsid_protein_VP2__Norovirus__AFX81245
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccucccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccguccccgcccgcggcuccuccuccaccuccuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17464 - RNA, 807 nt, Artificial Sequence
  derived and/or modified sequence opt2 from capsid_protein_VP2__Norovirus__AFX81248
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccacccgcaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccguccccgcccgcggcuccuccuccaccuucuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17465 - RNA, 807 nt, Artificial Sequence
  derived and/or modified sequence opt2 from capsid_protein_VP2__Norovirus__AFX81251
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccguccccgcccgcggcuccuccuccaccuucuccaacuccuccaucgccaccuccgucuacuccaaccagaccaccuccacccgccucggcuccaccgccggcuccggcgccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17466 - RNA, 807 nt, Artificial Sequence
  derived and/or modified sequence opt2 from capsid_protein_VP2__Norovirus__AFX81254
auggccggcgccuucuucgccggccucgccuccgacguccucggcuccggccucggcucccucaucaacgccggcgccggcgccaucaaccagaccgucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacuggaccggcacccgcuacugggcccccgacgcccgcaccaccaccuacaacgccggccgcuucuccaccccccagcccuccggcgcccuccccggccgcgccaaccuccgcgccaccguccccgcccgcggcuccuccuccaccuucuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17467 - RNA, 807 nt, Artificial Sequence
  derived and/or modified sequence opt2 from capsid_protein_VP2__Norovirus__AFX81257
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccucccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccguccccgcccgcggcuccuccuccaccuccuccaacuccuccaucgccaccuccgucuacuccaaccagaccaccuccacccgccucggcuccaccgccggcuccggcaccuccgucuccucccaccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17468 - RNA, 807 nt, Artificial Sequence
  derived and/or modified sequence opt2 from capsid_protein_VP2__Norovirus__AFX81260
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacacccgccgccgcggcgagucccgcgucuga

SEQ ID NO: 17469 - RNA, 807 nt, Artificial Sequence; identical to SEQ ID NO: 17440
  derived and/or modified sequence opt2 from capsid_protein_VP2__Norovirus__AFX81263

SEQ ID NO: 17470 - RNA, 807 nt, Artificial Sequence; identical to SEQ ID NO: 17440
  derived and/or modified sequence opt2 from capsid_protein_VP2__Norovirus__AFX81269

SEQ ID NO: 17471 - RNA, 807 nt, Artificial Sequence; identical to SEQ ID NO: 17432
  derived and/or modified sequence opt2 from capsid_protein_VP2__Norovirus__AFX81272

SEQ ID NO: 17472 - RNA, 807 nt, Artificial Sequence; identical to SEQ ID NO: 17440
  derived and/or modified sequence opt2 from capsid_protein_VP2__Norovirus__AFX81275

SEQ ID NO: 17473 - RNA, 807 nt, Artificial Sequence; identical to SEQ ID NO: 17440
  derived and/or modified sequence opt2 from capsid_protein_VP2__Norovirus__AFX81278

SEQ ID NO: 17474 - RNA, 807 nt, Artificial Sequence
  derived and/or modified sequence opt2 from capsid_protein_VP2__Norovirus__AFX81281
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcgcccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17475 - RNA, 807 nt, Artificial Sequence; identical to SEQ ID NO: 17440
  derived and/or modified sequence opt2 from capsid_protein_VP2__Norovirus__AFX81284

SEQ ID NO: 17476 - RNA, 807 nt, Artificial Sequence
  derived and/or modified sequence opt2 from capsid_protein_VP2__Norovirus__AFX81287
auggccggcgccuucuucgccggccucgccuccgacguccucggcuccggccucuccucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgcccccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17477 - RNA, 807 nt, Artificial Sequence; identical to SEQ ID NO: 17440
  derived and/or modified sequence opt2 from capsid_protein_VP2__Norovirus__AFX81290

SEQ ID NO: 17478 - RNA, 807 nt, Artificial Sequence; identical to SEQ ID NO: 17432
  derived and/or modified sequence opt2 from capsid_protein_VP2__Norovirus__AFX81293

SEQ ID NO: 17479 - RNA, 807 nt, Artificial Sequence
  derived and/or modified sequence opt2 from capsid_protein_VP2__Norovirus__AFX81296
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcgucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17480 - RNA, 807 nt, Artificial Sequence
  derived and/or modified sequence opt2 from capsid_protein_VP2__Norovirus__AFX81299
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacuggacccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17481 - RNA, 807 nt, Artificial Sequence
  derived and/or modified sequence opt2 from capsid_protein_VP2__Norovirus__AFX81302
auggccggcgccuucuucgccggccucgccuccgacguccucuccuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaaggcccucgacugguccggcacccgcuacugggcccccgacgcccgcaccaccaccuacuccgccggccgcuucuccaccccccagcccuccggcgcccuccccggccgcaccaacccccgcgcccccauccccgcccgcggcucccccuccaccuccuccggcgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17482 - RNA, 807 nt, Artificial Sequence
  derived and/or modified sequence opt2 from capsid_protein_VP2__Norovirus__AFX81305
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccgaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacuccgccggccgcuucuccaccccccagcccuccggcacccuccccggccgcaccaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17483 - RNA, 807 nt, Artificial Sequence; identical to SEQ ID NO: 17432
  derived and/or modified sequence opt2 from capsid_protein_VP2__Norovirus__AFX81308

SEQ ID NO: 17484 - RNA, 807 nt, Artificial Sequence; identical to SEQ ID NO: 17440
  derived and/or modified sequence opt2 from capsid_protein_VP2__Norovirus__AFX81311

SEQ ID NO: 17485 - RNA, 807 nt, Artificial Sequence; identical to SEQ ID NO: 17432
  derived and/or modified sequence opt2 from capsid_protein_VP2__Norovirus__AFX81314

SEQ ID NO: 17486 - RNA, 807 nt, Artificial Sequence; identical to SEQ ID NO: 17432
  derived and/or modified sequence opt2 from capsid_protein_VP2__Norovirus__AFX81317

SEQ ID NO: 17487 - RNA, 807 nt, Artificial Sequence; identical to SEQ ID NO: 17432
  derived and/or modified sequence opt2 from capsid_protein_VP2__Norovirus__AFX81320

SEQ ID NO: 17488 - RNA, 807 nt, Artificial Sequence
  derived and/or modified sequence opt2 from capsid_protein_VP2__Norovirus__AFX81323
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacuccgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17489 - RNA, 807 nt, Artificial Sequence; identical to SEQ ID NO: 17440
  derived and/or modified sequence opt2 from capsid_protein_VP2__Norovirus__AFX81326

SEQ ID NO: 17490 - RNA, 807 nt, Artificial Sequence; identical to SEQ ID NO: 17432
  derived and/or modified sequence opt2 from capsid_protein_VP2__Norovirus__AGE89434

SEQ ID NO: 17491 - RNA, 807 nt, Artificial Sequence; identical to SEQ ID NO: 17432
  derived and/or modified sequence opt2 from capsid_protein_VP2__Norovirus__AGE89437

SEQ ID NO: 17492 - RNA, 807 nt, Artificial Sequence
  derived and/or modified sequence opt2 from capsid_protein_VP2__Norovirus__AGE89440
auggccggcgccuucuucgccggccucgccuccgacguccucggcuccggccucggcucccucaucuccgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccguccccgcccgcggcuccuccuccaccuucuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17493 - RNA, 807 nt, Artificial Sequence
  derived and/or modified sequence opt2 from capsid_protein_VP2__Norovirus__AGE89443
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccguccccgcccgcggcuccuccuccaccuccuccaacgccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17494 - RNA, 807 nt, Artificial Sequence
  derived and/or modified sequence opt2 from capsid_protein_VP2__Norovirus__AGE89449
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcguccuccccggccgcgccaaccuccgcgccaccguccccgcccgcggcuccuccuccaccuucuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17495 - RNA, 807 nt, Artificial Sequence; identical to SEQ ID NO: 17474
  derived and/or modified sequence opt2 from capsid_protein_VP2__Norovirus__AGE89455

SEQ ID NO: 17496 - RNA, 807 nt, Artificial Sequence; identical to SEQ ID NO: 17432
  derived and/or modified sequence opt2 from capsid_protein_VP2__Norovirus__AGE89458

SEQ ID NO: 17497 - RNA, 807 nt, Artificial Sequence; identical to SEQ ID NO: 17440
  derived and/or modified sequence opt2 from capsid_protein_VP2__Norovirus__AGE89461

SEQ ID NO: 17498 - RNA, 807 nt, Artificial Sequence
  derived and/or modified sequence opt2 from capsid_protein_VP2__Norovirus__AGE89464
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccacccccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17499 - RNA, 807 nt, Artificial Sequence; identical to SEQ ID NO: 17432
  derived and/or modified sequence opt2 from capsid_protein_VP2__Norovirus__AGE89467

SEQ ID NO: 17500 - RNA, 807 nt, Artificial Sequence
  derived and/or modified sequence opt2 from capsid_protein_VP2__Norovirus__AGE89470
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcgccaccaccuacaacgccggccgcuucuccaccccccagcccuccggcacccuccccggccgcaucaacccccgcacccccacccccgcccgcggcucccccuccaccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17501 - RNA, 807 nt, Artificial Sequence
  derived and/or modified sequence opt2 from capsid_protein_VP2__Norovirus__AGE89473
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcgcccuccccggccgcaucaacccccgcacccccacccccgcccgcggcuccuccuccaccuccuccaacgccuccaucgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17502 - RNA, 807 nt, Artificial Sequence
  derived and/or modified sequence opt2 from capsid_protein_VP2__Norovirus__AGE89476
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuucaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17503 - RNA, 807 nt, Artificial Sequence
  derived and/or modified sequence opt2 from capsid_protein_VP2__Norovirus__AGE89479
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccaguccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccaccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17504 - RNA, 807 nt, Artificial Sequence; identical to SEQ ID NO: 17440
  derived and/or modified sequence opt2 from capsid_protein_VP2__Norovirus__AGE89482

SEQ ID NO: 17505 - RNA, 807 nt, Artificial Sequence
  derived and/or modified sequence opt2 from capsid_protein_VP2__Norovirus__AGE89485
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccgcaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17506 - RNA, 807 nt, Artificial Sequence
  derived and/or modified sequence opt2 from capsid_protein_VP2__Norovirus__AGE89488
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccgccccccagcccuccggcucccuccccggccgcaucaacccccgcgcccccacccccgcccgcgucuccuccuccaccuccuccaacgccuccaccgucaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17507 - RNA, 807 nt, Artificial Sequence; identical to SEQ ID NO: 17432
  derived and/or modified sequence opt2 from capsid_protein_VP2__Norovirus__AGE89491

SEQ ID NO: 17508 - RNA, 807 nt, Artificial Sequence
  derived and/or modified sequence opt2 from capsid_protein_VP2__Norovirus__AGE89494
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaucaccuacaacgccggccgcuucuccaccccccagcccuccggcacccuccccggccgcaucaacccccgcgcccccacccccgcccgcggcuccuccuccaccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17509 - RNA, 807 nt, Artificial Sequence
  derived and/or modified sequence opt2 from capsid_protein_VP2__Norovirus__AGE89497
auggccggcgccuucuucgccggccucgccuccgacguccucggcuccggccucggcucccucaucuccgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17510 - RNA, 807 nt, Artificial Sequence; identical to SEQ ID NO: 17432
  derived and/or modified sequence opt2 from capsid_protein_VP2__Norovirus__AGE89500

SEQ ID NO: 17511 - RNA, 807 nt, Artificial Sequence; identical to SEQ ID NO: 17432
  derived and/or modified sequence opt2 from capsid_protein_VP2__Norovirus__AGE89503

SEQ ID NO: 17512 - RNA, 807 nt, Artificial Sequence
  derived and/or modified sequence opt2 from capsid_protein_VP2__Norovirus__AGE89506
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccaugcacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17513 - RNA, 807 nt, Artificial Sequence
  derived and/or modified sequence opt2 from capsid_protein_VP2__Norovirus__AGE89509
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcucccuccccggccgcaucaacccccgcgcccccacccccgcccgcgccuccuccuccaucuccuccaacgccuccaccgucaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17514 - RNA, 807 nt, Artificial Sequence; identical to SEQ ID NO: 17432
  derived and/or modified sequence opt2 from capsid_protein_VP2__Norovirus__AGE89512

SEQ ID NO: 17515 - RNA, 807 nt, Artificial Sequence; identical to SEQ ID NO: 17440
  derived and/or modified sequence opt2 from capsid_protein_VP2__Norovirus__AGE89515

SEQ ID NO: 17516 - RNA, 807 nt, Artificial Sequence
  derived and/or modified sequence opt2 from capsid_protein_VP2__Norovirus__AGE89518
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcagaccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17517 - RNA, 807 nt, Artificial Sequence
  derived and/or modified sequence opt2 from capsid_protein_VP2__Norovirus__AGE89521
auggccggcgccuucuucgccggccucgccuccgacguccucggcuccggccucggcucccucaucaacgccggcgccggcgccaucaaccagaagaucgacuucgagaacaaccgcaagcuccagcaggucuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17518 - RNA, 807 nt, Artificial Sequence; identical to SEQ ID NO: 17432
  derived and/or modified sequence opt2 from capsid_protein_VP2__Norovirus__AGE89524

SEQ ID NO: 17519 - RNA, 807 nt, Artificial Sequence
  derived and/or modified sequence opt2 from capsid_protein_VP2__Norovirus__AGE89530
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaccaacccccgcacccccacccccgcccgcggcuccuccuccaccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17520 - RNA, 807 nt, Artificial Sequence
  derived and/or modified sequence opt2 from capsid_protein_VP2__Norovirus__AGE89533
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaucaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacuccgccggccgcuucuccaccccccagcccuccggcacccuccccggccgcaucaacccccgcacccccacccccgcccgcggcuccuccuccaccuucuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17521 - RNA, 807 nt, Artificial Sequence; identical to SEQ ID NO: 17440
  derived and/or modified sequence opt2 from capsid_protein_VP2__Norovirus__AGE89536

SEQ ID NO: 17522 - RNA, 807 nt, Artificial Sequence; identical to SEQ ID NO: 17440
  derived and/or modified sequence opt2 from capsid_protein_VP2__Norovirus__AGE89539

SEQ ID NO: 17523 - RNA, 807 nt, Artificial Sequence; identical to SEQ ID NO: 17440
  derived and/or modified sequence opt2 from capsid_protein_VP2__Norovirus__AGE89542

SEQ ID NO: 17524 - RNA, 807 nt, Artificial Sequence; identical to SEQ ID NO: 17440
  derived and/or modified sequence opt2 from capsid_protein_VP2__Norovirus__AGE89545

SEQ ID NO: 17525 - RNA, 807 nt, Artificial Sequence
  derived and/or modified sequence opt2 from capsid_protein_VP2__Norovirus__AGE89548
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaucaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17526 - RNA, 807 nt, Artificial Sequence; identical to SEQ ID NO: 17432
  derived and/or modified sequence opt2 from capsid_protein_VP2__Norovirus__AGE89551

SEQ ID NO: 17527 - RNA, 807 nt, Artificial Sequence
  derived and/or modified sequence opt2 from capsid_protein_VP2__Norovirus__AGE89554
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccgccccccagcccuccggcucccuccccggccgcaucaacccccgcgcccccacccccgcccgcgucuccuccuccaccuccuccaacgccuccaccgucaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacguccgccgccgcggcgagucccgcgucuga

SEQ ID NO: 17528 - RNA, 807 nt, Artificial Sequence; identical to SEQ ID NO: 17440
  derived and/or modified sequence opt2 from capsid_protein_VP2__Norovirus__AGE89557

SEQ ID NO: 17529 - RNA, 807 nt, Artificial Sequence
  derived and/or modified sequence opt2 from capsid_protein_VP2__Norovirus__AGE89560
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacucccgcacccccacccccgcccgcggcuccuccuccaccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17530 - RNA, 807 nt, Artificial Sequence
  derived and/or modified sequence opt2 from capsid_protein_VP2__Norovirus__AGE89563
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcaugcuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17531 - RNA, 807 nt, Artificial Sequence
  derived and/or modified sequence opt2 from capsid_protein_VP2__Norovirus__AGE89566
auggccggcgccuucuucgccggccucgccuccgacguccucuccuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcauccccacccccgcccgcggcuccuccuccaccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17532 - RNA, 807 nt, Artificial Sequence; identical to SEQ ID NO: 17440
  derived and/or modified sequence opt2 from capsid_protein_VP2__Norovirus__AGE89569

SEQ ID NO: 17533 - RNA, 807 nt, Artificial Sequence; identical to SEQ ID NO: 17440
  derived and/or modified sequence opt2 from capsid_protein_VP2__Norovirus__AGE89572

SEQ ID NO: 17534 - RNA, 807 nt, Artificial Sequence
  derived and/or modified sequence opt2 from capsid_protein_VP2__Norovirus__AGE89578
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccucgagcgcgucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17535 - RNA, 807 nt, Artificial Sequence
  derived and/or modified sequence opt2 from capsid_protein_VP2__Norovirus__AGE89581
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggaggucaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17536 - RNA, 807 nt, Artificial Sequence; identical to SEQ ID NO: 17530
  derived and/or modified sequence opt2 from capsid_protein_VP2__Norovirus__AGE89587

SEQ ID NO: 17537 - RNA, 807 nt, Artificial Sequence
  derived and/or modified sequence opt2 from capsid_protein_VP2__Norovirus__AGE89590
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccgagcgcgucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17538 - RNA, 807 nt, Artificial Sequence; identical to SEQ ID NO: 17432
  derived and/or modified sequence opt2 from capsid_protein_VP2__Norovirus__AGE89593

SEQ ID NO: 17539 - RNA, 807 nt, Artificial Sequence
  derived and/or modified sequence opt2 from capsid_protein_VP2__Norovirus__AGE89596
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccguccccgcccgcggcuccuccuccaccuccuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17540 - RNA, 807 nt, Artificial Sequence
  derived and/or modified sequence opt2 from capsid_protein_VP2__Norovirus__AGE89599
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaccaacccccgcacccccacccccgcccgcggcuccuccuccaucuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17541 - RNA, 807 nt, Artificial Sequence
  derived and/or modified sequence opt2 from capsid_protein_VP2__Norovirus__AGE89602
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgccuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17542 - RNA, 807 nt, Artificial Sequence
  derived and/or modified sequence opt2 from capsid_protein_VP2__Norovirus__AGE89605
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcucccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17543 - RNA, 807 nt, Artificial Sequence
  derived and/or modified sequence opt2 from capsid_protein_VP2__Norovirus__AGE89608
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccacuccaaccagaccgucuccacccgccucggcuacaccgccggcuccggcaccaacgucuccucccuccccuccaccgcccgcacccgcuccugggucgaggaccagaaccgcucccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17544 - RNA, 807 nt, Artificial Sequence
  derived and/or modified sequence opt2 from capsid_protein_VP2__Norovirus__AGE89611
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucuccgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgcccccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17545 - RNA, 807 nt, Artificial Sequence
  derived and/or modified sequence opt2 from capsid_protein_VP2__Norovirus__AGE89614
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccgagacccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcucccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17546 - RNA, 807 nt, Artificial Sequence; identical to SEQ ID NO: 17539
  derived and/or modified sequence opt2 from capsid_protein_VP2__Norovirus__AGE89617

SEQ ID NO: 17547 - RNA, 807 nt, Artificial Sequence; identical to SEQ ID NO: 17447
  derived and/or modified sequence opt2 from capsid_protein_VP2__Norovirus__AGE89620

SEQ ID NO: 17548 - RNA, 807 nt, Artificial Sequence
  derived and/or modified sequence opt2 from capsid_protein_VP2__Norovirus__AGE89623
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccguccccgcccgcggcuccuccuccaccuucuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuacgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17549 - RNA, 807 nt, Artificial Sequence
  derived and/or modified sequence opt2 from capsid_protein_VP2__Norovirus__AGE89626
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccguccccgcccgcggcuccuccuccaccuucuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17550 - RNA, 807 nt, Artificial Sequence
  derived and/or modified sequence opt2 from capsid_protein_VP2__Norovirus__AGE89629
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggcggcgccaaccuccgcgccaccguccccgcccgcggcuccuccuccaccuucuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17551 - RNA, 807 nt, Artificial Sequence; identical to SEQ ID NO: 17432
  derived and/or modified sequence opt2 from capsid_protein_VP2__Norovirus__AGE89635

SEQ ID NO: 17552 - RNA, 807 nt, Artificial Sequence
  derived and/or modified sequence opt2 from capsid_protein_VP2__Norovirus__AGE89638
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgccuccaccgccaccuccauccaccucaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17553 - RNA, 807 nt, Artificial Sequence
  derived and/or modified sequence opt2 from capsid_protein_VP2__Norovirus__AGE89641
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaccuccuccaacgucuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17554 - RNA, 807 nt, Artificial Sequence
  derived and/or modified sequence opt2 from capsid_protein_VP2__Norovirus__AGE89644
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcgcccuccccggccgcaucaacccccgcacccccacccccgcccgcggcuccuccuccaccuccuccaacgccuccaccgccaccuccauccacuccaaccagaccgucuccacccgccucggcuccaccgccggcuccggcaccaacgucuccggccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17555 - RNA, 807 nt, Artificial Sequence
  derived and/or modified sequence opt2 from capsid_protein_VP2__Norovirus__AGE89647
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccaucuccuccaacgccuccaccgccaccuccauccacuccaaccagaccgucuccacccgccucggcuccaccgccggcuccggcaccaacgucuccuccuuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17556 - RNA, 807 nt, Artificial Sequence; identical to SEQ ID NO: 17530
  derived and/or modified sequence opt2 from capsid_protein_VP2__Norovirus__AGE89650

SEQ ID NO: 17557 - RNA, 807 nt, Artificial Sequence
  derived and/or modified sequence opt2 from capsid_protein_VP2__Norovirus__AGE89653
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccacuucuccaccccccaguccuccggcgcccuccccggccgcgccaaccuccgcgccgccguccccgcccgcggcuccuccuccaccuccuccaacuccuccaccgccaccuccgucuacuccaaccagaccaucuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgccccuccucccagggcaccgucuccaccguccccaaggagguccucgacuccuggaccggcgccuucaacacccgccgccagccccucuucgcccacauccgcaagcgcggcgagucccgcgccuga

SEQ ID NO: 17558 - RNA, 807 nt, Artificial Sequence; identical to SEQ ID NO: 17440
  derived and/or modified sequence opt2 from capsid_protein_VP2__Norovirus__AGE89656

SEQ ID NO: 17559 - RNA, 807 nt, Artificial Sequence
  derived and/or modified sequence opt2 from capsid_protein_VP2__Norovirus__AGE89659
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcauccccacccccgcccgcggcuccuccuccaccuccuccaacgccuccaccgccaccuccaucuacuccaaccagaccgucuccacccgccucggcuccgccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17560 - RNA, 807 nt, Artificial Sequence
  derived and/or modified sequence opt2 from capsid_protein_VP2__Norovirus__AGE89662
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccaacaccuccuccaacgccuccaccgccaccuccauccacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17561 - RNA, 807 nt, Artificial Sequence; identical to SEQ ID NO: 17447
  derived and/or modified sequence opt2 from capsid_protein_VP2__Norovirus__AGE89665

SEQ ID NO: 17562 - RNA, 807 nt, Artificial Sequence; identical to SEQ ID NO: 17560
  derived and/or modified sequence opt2 from capsid_protein_VP2__Norovirus__AGE89668

SEQ ID NO: 17563 - RNA, 807 nt, Artificial Sequence
  derived and/or modified sequence opt2 from capsid_protein_VP2__Norovirus__AGE89671
auggccggcgccuucuucgccggccucgccuccgacguccucggcuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucuccgcccccaugaccaagguccucgacugguccggcacccgcuacugggcccccgacgcccgcaccaccaccuacaacuccggccgcuucuccaccccccagcccuccggcacccuccccggccgcaucaacccccgcacccccacccccgcccgcggcuccuccuccaccuccuccaacgccuccaccgccaccuccauccaccucaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagauccucgacuccugggccggcgccuucaacacccgccgccagccccucuucgcccacauccgccgccgcggcgagucccgcgucuga

SEQ ID NO: 17564 - RNA, 807 nt, Artificial Sequence; identical to SEQ ID NO: 17560
  derived and/or modified sequence opt2 from capsid_protein_VP2__Norovirus__AGE89674

SEQ ID NO: 17565 - RNA, 807 nt, Artificial Sequence
  derived and/or modified sequence opt2 from capsid_protein_VP2__Norovirus__AGE99604
auggccggcgccuucuucgccggccucgccuccgacguccucuccuccggccucggcucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagcucaugaaggucaagcagaccauccuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcgcccuccccggccgcaucaacccccgcacccccauccccgcccgcggcucccccuccaucuccuccaacgccuccaccgccaccuccauccacuccaaccagaccgccuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggacguccucgacuccuggaccggcgccuucaacacccgccgccagccccucuucgcccacauccgccgccgcggcgagucccgcgucuga

SEQ ID NO: 17566 - RNA, 807 nt, Artificial Sequence
  derived and/or modified sequence opt2 from capsid_protein_VP2__Norovirus__AGE99607
auggccggccccuucuucgccggccucgccuccgacguccucggcuccggccucggcucccucaucuccgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccacccagaagcuccagcaggagcucaugaaggucaagcaggccguccuccucgagggcggcuucuccaccaccgacgccgcccgcggcgccaucaacgcccccaugaccaaggcccucgacugguccggcacccgcuacugggcccccgacgcccgcaucaccaccuacaacgccggccgcuucuccaccccccagccccucggcgcccuccccggccgcaccaacccccgcguccccgccuccgcccgcuccucccccuccucccucuccaacgcccccaccgccaccuccgucuacuccaaccagaccgccuccacccgccucggcuccuccgccggcuccggcgccggcgucuccucccuccccuccaccgcccgcacccgcuccugggucgaggaccagaacaagaaccucucccccuucaugaagggcgcccucaacaccuccuucgucaccccccccuccucccgcuccuccaaccagggcaccgucuccaccguccccaaggagauccucgacuccuggaccggcgccuucaacacccgccgccagccccucuucgcccacauccgcaagcgcggcgagucccgcgucuga

SEQ ID NO: 17567 - RNA, 807 nt, Artificial Sequence
  derived and/or modified sequence opt2 from capsid_protein_VP2__Norovirus__AGK36312
auggccggcgccuucuucgccggccucgccuccgacguccucggcuccggccucggcucccucaucaacgccggcgccggcgccaucaaccagaagaucgacuucgagaacaaccgcgagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcacccuccccggccgcaucaacccccgcacccccacccccgcccgcggcuccuccuccgccuccuccaacgccuccaccgccaccuccaucuacuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17568 - RNA, 807 nt, Artificial Sequence; identical to SEQ ID NO: 17539
  derived and/or modified sequence opt2 from capsid_protein_VP2__Norovirus__AGK36315

SEQ ID NO: 17569 - RNA, 639 nt, Artificial Sequence
  derived and/or modified sequence opt2 from capsid_protein_VP2__Norovirus__AGM33209
auggcccaggccaucaucggcgccaucgccgccuccaccgccggcuccgcccucggcgccggcauccaggucggcggcgaggccgcccuccagucccagcgcuaccagcagaaccuccagcuccaggagaacuccuucaagcacgaccgcgagaugaucggcuaccaggucgaggccuccaaccagcuccucgccaagaaccucgccacccgcuacucccuccuccgcgccggcggccucaccuccgccgacgccgcccgcuccgucgccggcgcccccgucacccgcaucgucgacuggaacggcguccgcgucuccgcccccgaguccuccgccaccacccuccgcuccggcggcuucauguccguccccauccccuucgccuccaagcagaagcagguccaguccuccggcaucuccaaccccaacuacucccccuccuccaucucccgcaccaccuccugggucgagucccagaacuccucccgcuucggcaaccucucccccuaccacgccgaggcccucaacaccgucuggcucaccccccccggcuccaccgccuccuccacccucuccuccgucccccgcggcuacuucaacaccgaccgccucccccucuucgccaacaaccgccgcuga

SEQ ID NO: 17570 - RNA, 639 nt, Artificial Sequence
  derived and/or modified sequence opt2 from capsid_protein_VP2__Norovirus__AGM33215
auggcccaggccaucaucggcgccaucgccgccuccaccgccggcuccgcccucggcgccggcauccaggucggcggcgaggccgcccuccagucccagcgcuaccagcagaaccuccagcuccaggagaacuccuucaagcacgaccgcgagaugaucggcuaccaggucgaggccuccaaccagcuccucgccaagaaccucgccacccgcuacucccuccuccgcgccggcggccucaccuccgccgacgccgcccgcuccgucgccggcguccccgucacccgcaucgucgacuggaacggcguccgcgucuccgcccccgaguccuccgccaccacccuccgcuccggcggcuucauguccguccccauccccuucgccuccaagcagaagcagguccaguccuccggcaucuccaaccccaacuacucccccuccuccaucucccgcaccaccuccugggucgagucccagaacuccucccgcuucggcaaccucucccccuaccacgccgaggcccucaacaccgucuggcucaccccccccggcuccaccgccuccuccacccucuccuccgucccccgcggcuacuucaacaccgaccgccucccccucuucgccaacaaccgccgcuga

SEQ ID NO: 17571 - RNA, 639 nt, Artificial Sequence; identical to SEQ ID NO: 17569
  derived and/or modified sequence opt2 from capsid_protein_VP2__Norovirus__AGM33218

SEQ ID NO: 17572 - RNA, 639 nt, Artificial Sequence; identical to SEQ ID NO: 17569
  derived and/or modified sequence opt2 from capsid_protein_VP2__Norovirus__AGM33221

SEQ ID NO: 17573 - RNA, 639 nt, Artificial Sequence; identical to SEQ ID NO: 17570
  derived and/or modified sequence opt2 from capsid_protein_VP2__Norovirus__AGM33224

SEQ ID NO: 17574 - RNA, 639 nt, Artificial Sequence; identical to SEQ ID NO: 17569
  derived and/or modified sequence opt2 from capsid_protein_VP2__Norovirus__AGM33227

SEQ ID NO: 17575 - RNA, 639 nt, Artificial Sequence; identical to SEQ ID NO: 17570
  derived and/or modified sequence opt2 from capsid_protein_VP2__Norovirus__AGM33230

SEQ ID NO: 17576 - RNA, 639 nt, Artificial Sequence
  derived and/or modified sequence opt2 from capsid_protein_VP2__Norovirus__AGM33233
auggcccaggccaucaucggcgccaucgccgccuccaccgccggcuccgcccucggcgccggcauccaggucggcggcgaggccgcccuccagucccagcgcuaccagcagaaccuccagcuccaggagaacuccuucaagcacgaccgcgagaugaucggcuaccaggucgaggccuccaaccagcuccucgccaagaaccucgccacccgcuacucccuccuccgcgccggcggccucaccuccgccgacgccgcccgcuccgucgccggcguccccgucacccgcaucgucgacuggaacggcguccgcgucuccgcccccgaguccuccgccaccacccuccgcuccggcggcuucauguccguccccauccccuucgccuccaagcagaagcagauccaguccuccggcaucuccaaccccaacuacucccccuccuccaucucccgcaccaccuccugggucgagucccagaacuccucccgcuucggcaaccucucccccuaccacgccgaggcccucaacaccgucuggcucaccccccccggcuccaccgccuccuccacccucuccuccgucccccgcggcuacuucaacaccgaccgccucccccucuucgccaacaaccgccgcuga

SEQ ID NO: 17577 - RNA, 639 nt, Artificial Sequence; identical to SEQ ID NO: 17569
  derived and/or modified sequence opt2 from capsid_protein_VP2__Norovirus__AGM33236

SEQ ID NO: 17578 - RNA, 639 nt, Artificial Sequence; identical to SEQ ID NO: 17569
  derived and/or modified sequence opt2 from capsid_protein_VP2__Norovirus__AGM33239

SEQ ID NO: 17579 - RNA, 639 nt, Artificial Sequence; identical to SEQ ID NO: 17569
  derived and/or modified sequence opt2 from capsid_protein_VP2__Norovirus__AGM33242

SEQ ID NO: 17580 - RNA, 639 nt, Artificial Sequence; identical to SEQ ID NO: 17570
  derived and/or modified sequence opt2 from capsid_protein_VP2__Norovirus__AGM33245

SEQ ID NO: 17581 - RNA, 639 nt, Artificial Sequence; identical to SEQ ID NO: 17569
  derived and/or modified sequence opt2 from capsid_protein_VP2__Norovirus__AGT17786

SEQ ID NO: 17582 - RNA, 639 nt, Artificial Sequence; identical to SEQ ID NO: 17569
  derived and/or modified sequence opt2 from capsid_protein_VP2__Norovirus__AGT17793

SEQ ID NO: 17583 - RNA, 807 nt, Artificial Sequence
  derived and/or modified sequence opt2 from capsid_protein_VP2__Norovirus__AGT17796
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaucgagaugcuccaggcccagaucgaggccaccaagaagcuccagcaggagaugaugcgcgccaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccagcccggccgcgccaaccuccgcgccaccguccccgcccgcggcuccuccuccaccuccuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17584 - RNA, 807 nt, Artificial Sequence
  derived and/or modified sequence opt2 from capsid_protein_VP2__Norovirus__AGT17799
auggccggcgccuucuucgccggccucgccuccgacguccucggcuccggccucggcucccucaucaacgccggcgccggcgccaucaaccagaaggucgaguucgagaacaaccgcaagcuccagcaggacuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagguccucgacugguccggcacccgcuacugggcccccggcgcccgcaccaccaccuacaacgccggcuacuucuccaccccccagcacuccggcgcccuccccggccgcgccaaccuccgcgccgucguccccgcccgcggcuccucccgcgucuccuccaacuccuccaccgccaccuccgucuacuccaaccagaccgccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucaacucccaggccggcgucuucaacacccgccgccagccccucuucgcccacauccgccgccgcggcgagucccgcgccuga

SEQ ID NO: 17585 - RNA, 639 nt, Artificial Sequence; identical to SEQ ID NO: 17569
  derived and/or modified sequence opt2 from capsid_protein_VP2__Norovirus__AGT17804

SEQ ID NO: 17586 - RNA, 639 nt, Artificial Sequence; identical to SEQ ID NO: 17569
  derived and/or modified sequence opt2 from capsid_protein_VP2__Norovirus__AGT17807

SEQ ID NO: 17587 - RNA, 639 nt, Artificial Sequence; identical to SEQ ID NO: 17569
  derived and/or modified sequence opt2 from capsid_protein_VP2__Norovirus__AGT17810

SEQ ID NO: 17588 - RNA, 807 nt, Artificial Sequence
  derived and/or modified sequence opt2 from capsid_protein_VP2__Norovirus__AGT17814
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccagucccagaucgacgccaccaagaagcuccagcaggagaugaugcgcgucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccagcccuccggcgccccccccggccgcgccaaccuccgcgccgccguccccgcccgcggcuccuccuccaccuccuccaacuccuccaucgccaccuccauguacuccaaccagaccaccuccacccgccucggcuccaccgccggcuccggcaccuccgucuccucccuccccuccuccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17589 - RNA, 807 nt, Artificial Sequence
  derived and/or modified sequence opt2 from capsid_protein_VP2__Norovirus__AGT17820
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgccaagcaggccaugcuccucgagggcggcuucuccgagaccgacgccgcccgcggcgccaucaacgcccccaugaccaagacccucgacugguccggcacccgcuacugggcccccgacgcccgcaccaccaccuacuccgccggccgcuucuccaccccccagcccuccggcgcccuccccggccgcgccaaccuccgcgccaccguccccgcccgcggcuccuccuccaccuccuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17590 - RNA, 807 nt, Artificial Sequence
  derived and/or modified sequence opt2 from capsid_protein_VP2__Norovirus__AGT17824
auggccggcgccuucuucgccggccucgccuccgacguccucggcuccggccucggcucccucaucaacgccggcgccggcgccaucaaccagaaggucgaguucgagaacaaccgcaagcuccagcaggacuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccacuucuccaccccccagcacuccggcgcccuccccggccgcgccaaccuccgcgccaccguccccgcccgcggcuccucccgcgccuccuccaacuccuccaccgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucaacucccgcaccggcgccuucaacacccgccgccagccccucuucgcccacauccgccgccagggcgagucccgcgccuga

SEQ ID NO: 17591 - RNA, 639 nt, Artificial Sequence; identical to SEQ ID NO: 17569
  derived and/or modified sequence opt2 from capsid_protein_VP2__Norovirus__AGT17827

SEQ ID NO: 17592 - RNA, 807 nt, Artificial Sequence
  derived and/or modified sequence opt2 from capsid_protein_VP2__Norovirus__AGT17831
auggccggcgccaucaucgccggccucgccuccgacguccucuccuccggccucggcucccucaucaacgccggcgccggcgucaucaaccagaaggucgacuucgagaacaacaagcagcuccagcagaacuccuuccaguucuccuccaaccuccagcaggccuccuuccagcacgacaaggagaugcuccaggcccagaucgaggccaccaagaagcuccagcaggagaugaugggcaucaagcaggccguccuccucaagggcggcuucuccgagaccgacgccgcccgcggcgccgucaacgcccccaugaccaagguccucgacugguccggcacccgcuacugggcccccaacgccuccaccaccaccuacaacgccggccgcuucuccaccccccagcccuccggcgcccuccccggccgcaccaaccuccgcaccgccgcccccgcccgcggcucccccuccaucuccuccaacgccuccaccgccaccuccgucuacuccaaccagaccgucuccacccgccucggcaccuccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17593 - RNA, 639 nt, Artificial Sequence; identical to SEQ ID NO: 17569
  derived and/or modified sequence opt2 from capsid_protein_VP2__Norovirus__AGT17837

SEQ ID NO: 17594 - RNA, 807 nt, Artificial Sequence
  derived and/or modified sequence opt2 from capsid_protein_VP2__Norovirus__AGT17843
auggccggcgccuucuucgccggccucgccuccgacguccucggcuccggccucggcucccucaucaacgccggcgccggcgccaucaaccagaaggucgaguucgagaacaaccgcaagcuccagcaggacuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagguccucgacuggaacggcacccgcuacugggcccccggcgcccgcaccaccaccuacaacgccggccacuucuccaccccccagcacuccggcgcccuccccggccgcgccaaccuccgcgccgccguccccgcccgcggcuccucccgcgccuccuccaacuccuccaccgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucaacucccagaccggcgccuucaacacccgccgccagccccucuucgcccacauccgccgccgcggcgagucccgcgccuga

SEQ ID NO: 17595 - RNA, 807 nt, Artificial Sequence
  derived and/or modified sequence opt2 from capsid_protein_VP2__Norovirus__AGX85887
auggccggcgccuucuucgccggccucgccuccgacguccucuccuccggccucggcucccucaucaacgccggcgccggcgccaucaaccagaccgucgaguucgagaacaaccgcaagcuccagcaggccuccuuccaguucuccuccaaccuccagcaggccuccuuccagcacgacaaggagaugcuccagucccagaucgacgccaccaagaagcuccagcaggagaugaugcgcgucaagcaggccaugcuccucgagggcggcuucuccgagaccgacgccgcccgcggcgccaucaacgcccccaugaccaagguccucgacugguccggcacccgcuacugggcccccgacgcccgcaccaccaccuacaacgccggccgcuucuccaccccccaguccuccggcgccccccccggccgcgccaaccuccgcgccgccguccccgcccagggcuccuccuccaccuccuccaacuccuccaucgccaccuccauguacuccaaccagaccaccuccacccgccucggcuccaccgccggcuccggcaccuccgucuccucccuccccuccuccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17596 - RNA, 807 nt, Artificial Sequence
  derived and/or modified sequence opt2 from capsid_protein_VP2__Norovirus__AGX85893
auggccggcgccuucuucgccggccucgccuccgacguccucggcuccggccucggcucccucaucaacgccggcgccggcgccaucaaccagaaggucgaguucgagaacaaccgcaagcuccagcaggacuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagguccucgacugguccggcacccgcuacugggcccccggcgcccgcaccaccaccuacaacgccggcuacuucuccaccccccagcacuccggcgcccuccccggccgcgccaaccuccgcgccgccguccccgcccgcggcuccucccgcgucuccuccaacuccuccaccgccaccuccgucuacuccaaccagaccgccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucaacucccagaccggcgucuucaacacccgccgccagccccucuucgcccacauccgccgccgcggcgagucccgcgccuga

SEQ ID NO: 17597 - RNA, 807 nt, Artificial Sequence
  derived and/or modified sequence opt2 from capsid_protein_VP2__Norovirus__AGX85896
auggccggcgccuucuucgccggccucgccuccgacguccucggcuccggccucggcucccucaucaacgccggcgccggcgccaucaaccagaaggucgaguucgagaacaaccgcaagcuccagcaggacuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagguccucgacugguccggcacccgcuacugggcccccggcgcccgcaccaccaccuacaacgccggcuacuucuccaccccccagcacuccggcgcccuccccggccgcgccaaccuccgcgccgccguccccgcccgcggcuccucccgcgucuccuccaacuccuccaccgccaccuccgucuacuccaaccagaccgccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucaacucccagaccggcgccuucaacacccgccgccagccccucuucgcccacauccgccgccgcggcgagucccgcgccuga

SEQ ID NO: 17598 - RNA, 807 nt, Artificial Sequence
  derived and/or modified sequence opt2 from capsid_protein_VP2__Norovirus__AGX85905
auggccggcgccuucuucgccggccucgccuccgacguccucuccuccggccucggcucccucaucaacgccggcgccggcgccaucaaccagcgcaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagcucaugaaggucaagcaggccaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcgcccuccccggccgcaucaacccccgcacccccauccccgcccgcggcucccccuccaucuccuccaacgucuccaccgccaacuccauccacuccaaccagaccgccuccacccgccucggcuccaccgccggcuccggcaccgacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggacguccucgacuccuggaccggcgccuucaacacccgccgccagccccucuucgcccacauccgccgccgcggcgagucccgcgucuga

SEQ ID NO: 17599 - RNA, 807 nt, Artificial Sequence
  derived and/or modified sequence opt2 from capsid_protein_VP2__Norovirus__AGX85914
auggccggcgccuucuucgccggccucgccuccgacguccucggcuccggccucggcucccucaucaacgccggcgccggcgccaucaaccagaaggucgaguucgagaacaaccgcaagcuccagcaggacuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagguccucgacugguccggcacccgcuacugggcccccggcgcccgcaccaccaccuacaacgccggcuacuucuccaccccccagcacuccggcgcccuccccggccgcgccaaccuccgcgccgucguccccgcccgcggcuccucccgcgucuccuccaacuccuccaccgccaccuccgucuacuccaaccagaccgccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucaacucccagaccggcgucuucaacacccgccgccagccccucuucgcccacauccgccgccgcggcgagucccgcgccuga

SEQ ID NO: 17600 - RNA, 807 nt, Artificial Sequence; identical to SEQ ID NO: 17595
  derived and/or modified sequence opt2 from capsid_protein_VP2__Norovirus__AGX85917

SEQ ID NO: 17601 - RNA, 807 nt, Artificial Sequence; identical to SEQ ID NO: 17592
  derived and/or modified sequence opt2 from capsid_protein_VP2__Norovirus__AGX85923

SEQ ID NO: 17602 - RNA, 807 nt, Artificial Sequence
  derived and/or modified sequence opt2 from capsid_protein_VP2__Norovirus__AGX85926
auggccggcgccaucaucgccggccucgccuccgacguccucuccuccggccucggcucccucaucaacgccggcgccggcgccaucaaccagaccaucgacuucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgccccccccggccgcgccaaccuccgcgccaccacccccgcccgcggcuccuccuccaccuccuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcacccgcggcgagucccgcgucuga

SEQ ID NO: 17603 - RNA, 807 nt, Artificial Sequence; identical to SEQ ID NO: 17599
  derived and/or modified sequence opt2 from capsid_protein_VP2__Norovirus__AGX85932

SEQ ID NO: 17604 - RNA, 807 nt, Artificial Sequence; identical to SEQ ID NO: 17599
  derived and/or modified sequence opt2 from capsid_protein_VP2__Norovirus__AGX85935

SEQ ID NO: 17605 - RNA, 780 nt, Artificial Sequence
  derived and/or modified sequence opt2 from capsid_protein_VP2__Norovirus__AHI59155
auggccuccgccuuccucgccggccucgccggcgacgucaucaccaacggcgucggcucccucaucaacgccggcgccaacgccgucaaccagaaggucgaguacgacuucaacaagcagcuccagauggccuccuucaagcacgacaaggagaugcuccagucccagguccucgccaccaagcagcuccagcaggagaugaugaacauccgccagggcguccucaccgccggcggcuucucccccgccgacgccgcccgcggcgccgucaacgcccccaugaccaagauccucgacuggaacggcacccgcuacugggcccccaacuccaugaagaccaccuccuacuccggccaguucuccuccucccccguccacaagucccccgcccccucccagcacaccgcccuccccaagucccgccuccagaacgacuucgccuccgucuacuccuuccccuccuccgucuccucccaguccacccacuccaccgcccucuccgccggcaccggcuccucccgcuccaucucccccuccaccgccacccccacccucucccgcaccuccgacuggguccgcggccagaacgagcgccucucccccuucauggacggcgcccuccagaccgccuucgucaccccccccuccuccaaggccuccuccaacggcaccgucuccaccguccccaaggccguccucgacuccuggacccccauguucaacacccaccgccagccccucuucgcccacccccgccgccgcggcgagucccaggucuga

SEQ ID NO: 17606 - RNA, 807 nt, Artificial Sequence
  derived and/or modified sequence opt2 from capsid_protein_VP2__Norovirus__AHI59158
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccguccccgcccgcggcuccuccaacaccuccuccuccuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17607 - RNA, 780 nt, Artificial Sequence
  derived and/or modified sequence opt2 from capsid_protein_VP2__Norovirus__AHI59160
auggccggcgccuucgucgccggccucgccggcgacguccucuccaacggccucuccucccucaucaacgccggcgccaacgccaucaaccagcgcgccgaguucgacuucaaccagaagcuccagcagaacuccuucaaccacgacaaggagaugcuccaggcccagauccaggccaccaagcagcuccaggccgacaugauggccaucaagcagggcguccucaccgccggcggcuucucccccgccgacgccgcccgcggcgccgucaacgcccccaugacccaggcccucgacuggaacggcacccgcuacugggcccccggcuccaugcgcaccaccuccuacuccggcaaguucaccuccaccgcccccguccgccaggccgacuuccagcacacccagucccgccccuccuccggcuccuccgucuccuccuucgccacccaguccucccgccccacccucaccaccaccaccggcuccucccacggcaccgccuccuccaacuccacccgcuccaccucccucucccaguccaccgucucccgcgccaccucccgcaccuccgaguggguccgcgaccagaaccgcaaccucgagcccuacaugcacggcgcccuccagaccgccuucgucaccccccccuccucccgcgccuccgacggcaccgucuccaccguccccaagggcguccucgacuccuggacccccgccuucaacacccgccgccagccccucuucgcccaccuccgcaagcgcggcgagucccacgccuga

SEQ ID NO: 17608 - RNA, 807 nt, Artificial Sequence
  derived and/or modified sequence opt2 from capsid_protein_VP2__Norovirus__AHI59163
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaucaccaccuacaacgccggccgcuuccccaccccccagcucuccggcgcccuccccggccgcgccaaccuccgcgccaccguccccgcccgcggcucccccuccaccuccuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuuccuccgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17609 - RNA, 807 nt, Artificial Sequence
  derived and/or modified sequence opt2 from capsid_protein_VP2__Norovirus__AHI59166
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcagggcaugaugaaggucaagcaggccaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcgcccuccccggccgcaacaaccuccgcgccaccguccccgcccgcggcuccuccuccacccucuccuccauccccaccgccaccuccgucuacuccaaccagaccgucuccacccgccucggcuccuccgccggcuccggcaccuccgucuccucccuccccuccaccgcccgcacccgcuccugggucgaggaccagaacaagaaccucucccccuucaugcgcggcgcccucaacaccuccuucgucaccccccccuccucccgcuccuccucccagggcaccgucuccaccguccccaaggagauccucgacuccuggaccggcgccuucaacacccgccgccagccccucuucgcccacguccgcaagcgcggcgagucccgcgucuga

SEQ ID NO: 17610 - RNA, 807 nt, Artificial Sequence
  derived and/or modified sequence opt2 from capsid_protein_VP2__Norovirus__AHX22026
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggucaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcgcccuccccggccgcgccaaccuccgcgucaccgcccccgcccgcggcuccuccuccaccuccuccaacuccuccaucgccaccuccgucuacuccucccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17611 - RNA, 807 nt, Artificial Sequence
  derived and/or modified sequence opt2 from capsid_protein_VP2__Norovirus__AHX22029
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggucaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcguccuccccggccgcgccaaccuccgcgacgccguccccgcccgcggcuccuccuccaaguccuccaacuccuucaccgccaccuccgucuacuccaaccagaccaccuccacccgccucggcuccaccgccggcuccggcaccuccgucuccucccuccccuccaccgcccgcacccgcuccugggucgaggaccagucccgcaacgucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17612 - RNA, 807 nt, Artificial Sequence
  derived and/or modified sequence opt2 from capsid_protein_VP2__Norovirus__AHX22033
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggucaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcgcccucuccggccgcgccaaccuccgcgccaccgcccccgcccgcggcuccuccuccaccuccuccaacuccuccaucgccaccuccgucuacuccaaccagaccaccuccacccgccucggcuccaccgccggcuccggcaccuccgucuccuccccccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17613 - RNA, 807 nt, Artificial Sequence
  derived and/or modified sequence opt2 from capsid_protein_VP2__Norovirus__AHX22036
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccucccuccgcgccaccguccccgcccgcggcuccuccuccauguccuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccuccaucuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17614 - RNA, 807 nt, Artificial Sequence
  derived and/or modified sequence opt2 from capsid_protein_VP2__Norovirus__AHX22039
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcgcccuccccggccgcgccaaccuccgcgacgccguccccgcccgcggcuccuccuccaaguccuccaacuccuccaccgccaccuccgucuacuccaaccagaccaccuccacccgccucggcuccaccgccggcuccggcaccuccgucuccucccuccccuccaccgcccgcacccgcuccugggucgaggaccagucccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17615 - RNA, 807 nt, Artificial Sequence
  derived and/or modified sequence opt2 from capsid_protein_VP2__Norovirus__AHX22042
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcguccuccccggccgcgccaaccuccgcgacgccguccccgcccgcggcuccuccuccaaguccuccaacuccuucaccgccaccuccgucuacuccaaccagaccaccuccacccgccucggcuccaccgccggcuccggcaccuccgucuccucccuccccuccaccgcccgcacccgcuccugggucgaggaccagucccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17616 - RNA, 807 nt, Artificial Sequence
  derived and/or modified sequence opt2 from capsid_protein_VP2__Norovirus__AHX22048
auggccggcgccuucuucgccggccucgccuccgacguccucggcuccggccucuccucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcgcccuccccggccgcgccaaccuccgcgccgccguccccgcccgcggcuccuccuccauguccuccaacuccuccaccgccaccuccgucuacuccaaccagaccaccuccacccgccucggcuccaccgccggcuccggcaccuccgucuccucccuccccuccaccgcccgcauccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgccuga

SEQ ID NO: 17617 - RNA, 807 nt, Artificial Sequence; identical to SEQ ID NO: 17613
  derived and/or modified sequence opt2 from capsid_protein_VP2__Norovirus__AHX22051

SEQ ID NO: 17618 - RNA, 807 nt, Artificial Sequence
  derived and/or modified sequence opt2 from capsid_protein_VP2__Norovirus__AHX22055
auggccggcgccuucuucgccggccucgccuccgacguccucggcuccggccucuccucccucaucaacgccggcgccggcgccaucaaccagaaggucgaguacgagaacaaccgcaagcuccagcaggccuccuuccaguucuccuccaaccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccguccccgcccgcggcuccuccuccaccuccuccaacuccuccaucgccaccuccgucuacuccaaccagaccacccucacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17619 - RNA, 693 nt, Artificial Sequence
  derived and/or modified sequence opt2 from capsid_protein_VP2__Norovirus__AII02849
auggccggcgccuucaucgccggccucgccggcgacaugcucaccaacaccgucggcucccucgucaacgccggcgccaacgccaucaaccagaccaucgacuucgagaacaacaaguaccuccagaacgccuccuucaaccacgacaaggagaugcucaacgcccagaucgaggccaccaagcgccuccaggccgacaugaucgccaucaagcagggcguccucaccgccggcggcuucucccccaccgacgccgcccgcggcgccaucaacgcccccaugaccaagguccucgacuggaacggcacccgcuacugggcccccggcgccaccuccaccaccuccauguccggcggcuucaucaaccagaccguccaccgcuccacccccaacuucaagaccaaccaggcccccaagcccgcccccuccuccggcuccuccguccgcuccaacuccacccagaucaccucccucuccucccacuccuccggcuccucccgcuccuccggcuccaccgucgucuccuccauccccuccuccaaccgcacccgcgacugggucaaccagcagaacuucaaccucgagccccacaugcccggcucccuccgcaccgccuucgucaccccccccuccuccaccgccuccuccuccggcaccgucuccaccguccccaagaacguccucgacuccuga

SEQ ID NO: 17620 - RNA, 804 nt, Artificial Sequence
  derived and/or modified sequence opt2 from capsid_protein_VP2__Norovirus__AKE07101
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccguccuccucgagggcggcuucuccgagaccgacgccgcccgcggcgccaucaacgcccccaugaccaaggcccucgacugguccggcacccgcuacugggcccccgacgcccgcaccaccaccuacaacgccggccacuucuccaccccccagcccuccggcgccccccucggccgcgccaaccuccgcgccgccguccccacccgcggcuccuccuccaccuccuccaacuccuccaucgccaccuccgucuacuccaaccagaccgccuccacccgccucggcuccaccgccggcuccggcgccuccgucuccucccuccccuccaccgcccgcacccgcuccugggucgaggaccagcgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17621 - RNA, 807 nt, Artificial Sequence
  derived and/or modified sequence opt2 from capsid_protein_VP2__Norovirus__AKE07104
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccguccuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcauccuccccggccgcgccaaccuccgcgacaccguccccgcccgcggcuccuccuccaccuccuccaaguccuccaucgccaccucccucuacuccaaccagaccgccaccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgucuga

SEQ ID NO: 17622 - RNA, 807 nt, Artificial Sequence
  derived and/or modified sequence opt2 from capsid_protein_VP2__Norovirus__AKE07107
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggacaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccacuucuccaccccccagcccuccggcgcccuccccggccgcgccaaccuccgcgccgccguccccgcccgcggccccuccuccaccuccuccaacuccuccaccgccaccuccgucuacuccaaccagaccaccuccacccgccucggcuccaccgccggcuccggcgccuccgucuccucccuccccuccaccgcccgcaccgucaacuggguccgcgaccagaaccgcucccucucccccuucaugcgcggcgcccacaacaccuccuucgucaccccccccuccucccgcuccuccucccagggcaccgucuccaccguccccaaggagguccucgacuccuggaccggcgccuucaacacccgccgccagccccucuucgcccacauccgcacccgcggcgagucccgcgucuga

SEQ ID NO: 17623 - RNA, 765 nt, Artificial Sequence
  derived and/or modified sequence opt2 from capsid_protein_VP2__Norovirus__ALE30634
auggccggcgccuucaucgccggccucgccggcgacaugcucaccaacaccgucggcucccucgucaacgccggcgccggcgccaucaaccagaaggucgacuucgagaacaacaaguaccuccagaacgccuccuucaaccacgacaaggagaugcucaacgcccagaucgaggccaccaagcgccuccaggccgacaugaucgccaucaagcagggcguccucaccgccggcggcuucucccccaccgacgccgcccgcggcgccaucaacgcccccaucaccaagguccucgacugguccggcacccgcuacugggcccccaacgccaccuccaccaccuccauguccggcggcuucaccggccaggccguccaccgcgccacccccaacuucaagaccaaccaggcccccaaguccacccccuccuccggcuccuccguccgcuccuccuccacccagcucaccaaccucuccucccacuccuccggcuccucccgcuccuccggcuccaccauggucuccucccuccccuccuccucccgcacccgcgacugggucaaccagcagaacuucaaccucgagccccacaugcccggcucccuccgcaccgccuucgucaccccccccuccuccaccgccuccucccucgacaccgucuccaccguccccaaguccguccucgacuccuggacccccgccuucaacacccgccgccagccccucuucgcccaccuccgccgccgcggcgaguccaacaucuga

SEQ ID NO: 17624 - RNA, 765 nt, Artificial Sequence
  derived and/or modified sequence opt2 from capsid_protein_VP2__Norovirus__ALE30636
auggccggcgccuucaucgccggccucgccggcgacaugcucaccaacaccgucggcucccucgucaacgccggcgccggcgccaucaaccagaaggucgacuucgagaacaacaaguaccuccagaacgccuccuucaaccacgacaaggagaugcucaacgcccagaucgaggccaccaagcgccuccaggccgacaugaucgccaucaagcagggcguccucaccgccggcggcuucucccccaccgacgccgcccgcggcgccaucaacgcccccaucaccaagguccucgacugguccggcacccgcuacugggcccccaacgccaccuccaccaccuccauguccggcggcuucaccggccaggccguccaccgcgccacccccaacuucaagaccaaccaggcccccaaguccacccccuccuccggcuccuccguccgcuccuccuccacccagcucaccaaccucuccucccacuccuccggcuccucccgcuccuccggcuccaccauggucuccucccuccccuccuccucccgcacccgcgacugggucaaccagcagaacuucaaccucgagccccacaugcccggcucccuccgcaccgccuucgucaccccccccuccuccaccgccuccucccucgacaccgucuccaccguccccaaguccguccucgacuccuggaccuccgccuucaacacccaccgccagccccucuucgcccaccuccgcaagcgcggcgaguccaacgucuga

SEQ ID NO: 17625 - RNA, 780 nt, Artificial Sequence
  derived and/or modified sequence opt2 from capsid_protein_VP2__Norovirus__BAR42290
auggccggcgccuucaucgccggccucgccggcgacaugcucaccuccuccgucggcucccucgucaacgccggcgccaacgccaucaaccagaagaucgacuucgagaacaacaagcagcuccaguccgccuccuuccagcacgacaaggagaugcuccaggcccagguccgcgccaccaagcagcuccaguccgagaugaucgcccucaagcagggcguccucgccgccggcggcuucucccccaccgacgccgcccgcggcuccaucggcgcccccaugaccaagguccucgacugguccggcacccgcuacugggcccccaacuccaccaagaccaccggcuacuccggccaguucaccuccucccccguccacauguccucccccaacgccccccaguccaagcccgccaagccccgcucccucgcccccuccuccuccuccuccuccgucuacuccauguacacccaguccacccaccucaccuccggcuccuccuccaacgccuccuccgccuccaccaagcucaccucccucuccuccggcuccucccagaaccgcaccgccgagugggucaaccagcagcgcucccucucccccuucauguccggcgcccucaacaucucccacgucaccccccccuccucccgcgccuccuccuccggcaccgucuccaccguccccaaggagguccucgacuccuggaccuccgccuucaacacccaccgccagccccucuucgcccaccuccgcguccgcggcgagucccgcgucuga

SEQ ID NO: 17626 - RNA, 780 nt, Artificial Sequence
  derived and/or modified sequence opt2 from capsid_protein_VP2__Norovirus__BAR47617
auggccggcgccuucaucgccggccucgccggcgacaugcucaccuccuccgucggcucccucgucaacgccggcgccaacgccaucaaccagaagaucgacuucgagaacaacaagcagcuccaguccgccuccuuccagcacgacaaggagaugcuccaggcccaggucaaggccaccaagcagcuccaguccgagaugaucgcccucaagcagggcguccucgccgccggcggcuucucccccaccgacgccgcccgcggcgccaucggcgcccccaugaccaagguccucgacugguccggcacccgcuacugggcccccaacuccaccaagaccaccggcuacuccggccaguucaccuccucccccguccacaugcccucccccaacgccccccaguccaagcccgccaagccccgcucccucgcccccuccuccuccuccuccuccgucuacuccauguccacccaguccacccaccucaccuccggcuccuccuccaacgccuccuccgccuccaccaagcucaccaaccucuccuccggcuccucccagaaccgcaccgccgagugggucaaccagcagcgcucccucucccccuucauguccggcgcccucaacaucucccacgucaccccccccuccucccgcgccuccuccuccggcaccgucuccaccguccccaaggagguccucgacuccuggaccuccgccuucaacacccaccgccagccccucuucgcccaccuccgcguccgcggcgagucccgcgucuga

SEQ ID NO: 17627 - RNA, 780 nt, Artificial Sequence
  derived and/or modified sequence opt2 from capsid_protein_VP2__Norovirus__BAR63716
auggccggcgccuucaucgccggccucgccggcgacaugcucaccuccuccgucggcucccucgucaacgccggcgccaacgccaucaaccagaagaucgacuucgagaacaacaagcagcuccaguccgccuccuuccagcacgacaaggagaugcuccaggcccaggucaaggccaccaagcagcuccaguccgagaugaucgcccucaagcagggcguccucgccgccggcggcuucucccccaccgacgccgcccgcggcgccaucggcgcccccaugaccaagguccucgacugguccggcacccgcuacugggcccccaacuccaccaagaccaccggcuacuccggccaguucaccuccucccccguccgcaugcccucccccaacgccccccaguccaagcccgccaagccccgcucccucgcccccuccuccuccuccuccuccgucuacuccauguccacccaguccacccaccucaccuccggcuccuccuccaacgccuccuccgccuccaccaagcucaccaaccucuccuccggcuccucccagaaccgcaccgccgagugggucaaccagcagcgcucccucucccccuucauguccggcgcccucaacaucucccacgucaccccccccuccucccgcgccuccuccuccggcaccgucuccaccguccccaaggagguccucgacuccuggaccuccgccuucaacacccaccgccagccccucuucgcccaccuccgcguccgcggcgagucccgcgucuga

SEQ ID NO: 17628 - RNA, 780 nt, Artificial Sequence; identical to SEQ ID NO: 17626
  derived and/or modified sequence opt2 from capsid_protein_VP2__Norovirus__BAR63719

SEQ ID NO: 17629 - RNA, 780 nt, Artificial Sequence; identical to SEQ ID NO: 17626
  derived and/or modified sequence opt2 from capsid_protein_VP2__Norovirus__BAR63722

SEQ ID NO: 17630 - RNA, 807 nt, Artificial Sequence
  derived and/or modified sequence opt2 from capsid_protein_VP2__Norovirus__BAS02084
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagcgccuccagcaggagaugaugaaggucaagcaggccaugcuccucgagggcggcuucuccgagaccgacgccgcccgcggcgccaucaacgcccccaugaccaaggcccucgacuggaacggcacccgcuacugggcccccgacgcccgcaccaccaccuacaacgccggccgcuucuccaccccccagcccuccggcgcccuccccggccgcgccaaccuccgcgacgccguccccgcccgcggcuccuccuccaaguccuccaacuccuccaccgccaccuccgucuacuccaaccagaccaucuccacccgccucggcuccaccgccggcuccggcaccuccgucuccuccuuccccuccaccgcccgcacccgcuccugggucgaggaccagucccgcaaccucucccccuucaugcgcggcgcccacaacaucuccuucgucaccccccccuccucccgcuccuccucccagggcaccgucuccaccgucccccgcgagauccucgacuccuggaccggcgccuucaacacccgccgccagccccucuucgcccacauccgcaagcgcggcgagucccgcgucuga

SEQ ID NO: 17631 - RNA, 627 nt, Artificial Sequence
  derived and/or modified sequence opt2 from capsid_protein_VP2__Norovirus__CRL46953
auggcccaggccaucaucggcgccaucgccgccuccgccgccggcuccgcccucggcgccggcauccaggccggcgccgaggccgcccuccaggcccagcgcuaccagcaggaccucacccuccagcagaacuccuucaaccacgacaaggagaugcucggcuaccaggucgagauguccaacaagcuccucgccaagaaccucaacacccgcuacucccuccuccaggccggcggccucucccccuccgacgccgcccgcgccgucgccggcgcccccgucacccgccucgucgacuggggcggcguccgcgucgccgccccccaguccuccgccaccacccuccgcuccggcaacuucauggccgucccccuccccgcccagcccaagcagaagccccucgccuccgagggcuacuccaaccccgccuacgaccccaugcagcgcaccgccuccuggguccagucccagaacuccucccgcaacuggucccccuaccaccgccaggcccuccagaccgucugggucaccccccccggcuccaccuccuccuccuccgucuccaccgccccccgcggcuacuucaacaccgaccgccucccccucuucgccaaccuccgccgcuga

SEQ ID NO: 17632 - RNA, 630 nt, Artificial Sequence
  derived and/or modified sequence opt2 from capsid_protein_VP2__Norovirus__CRL46956
auggcccaggccgucaucggcgccaucgccgccuccgccgccggcuccauccucggcgccggcauccaggccggcgccgaggccggccuccaggcccagcgcuaccagcaggaccuccagcuccagcagaacuccuucaagcacgacaaggagaugcucggcuaccagguccaggccuccaacgcccuccucgccaagaaccucaacacccgcuacgcccuccuccaggccggcggccucuccuccgccgacgccgcccgcgccgucgccggcgcccccgucacccgcaucgucgacuggaacggcacccgcaucgccgcccccgccuccuccgccaccacccuccgcuccggcggcuucauggccguccccaucccccucuccuccaagaccaagcagcccgucauguccggccaggacaaccccaacuacgccgccuccuccaucucccgcaccgccuccuggguccagucccagaacuccaugcgcuccgucucccccuuccacuccgacgcccuccgcaccgucugggucaccccccccggcuccuccuccaccuccuccguccaguccuccuucuacggcgucuucaacaccgaccgccucccccucuucgccaaccgccgcuga

SEQ ID NO: 17633 - RNA, 807 nt, Artificial Sequence
  derived and/or modified sequence opt2 from capsid_protein_VP2__Norovirus__CRL46959
auggccggcgccuucuucgccggccucgccuccgacguccucggcuccggccucuccucccucaucaacgccggcgccggcgccaucaaccagaagaucgacuucgagaacaaccgcaagcuccagcaggccuccuuccaguucuccuccaaccuccagcaggccuccuuccagcacgacaaggagaugcuccaggcccaggucgaggccaccaagaagcuccagcaggagaugaugaaggucaagcaggccauccuccucgagggcggcuucuccgccaccgacgccgcccgcggcgccaucaacgcccccaugaccaagguccucgacuggaacggcacccgcuacugggcccccgacgcccgcaccaccaccuacaacaccggccacuucuccaccccccaguccuccggcgcccuccccggccgcaccaacccccgcauccccacccccgcccgcgccuccuccuccaccuccuccaacgccuccaccgccaccuccaucuccuccaaccagaccgucuccacccgccucggcuccaccgccggcuccggcaccaacgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaagggcguccucgacuccuggaccggcgccuucaacacccgccgccagccccucuucgccuacacccaccgccgcggcgagucccgcgucuga

SEQ ID NO: 17634 - RNA, 807 nt, Artificial Sequence
  derived and/or modified sequence opt2 from capsid_protein_VP2__Norovirus__CRL46962
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcgcccuccccggccgcgccaaccuccgcgacgccguccccgcccgcggccccuccuccaaguucuccaacuccuccaccgccaccuccgucuacuccaaccagaccaucuccacccgccucggcuccaccgccggcuccggcaccuccgucuccucccuccccuccaccgcccgcacccgcuccugggucgaggaccagucccgcaaccucucccccuucaugggcggcgcccacaacaucuccuucgucaccccccccuccucccgcuccuccucccagggcaccgucuccaccguccccaaggagauccucgacuccuggaccggcgccuucaacacccgccgccagccccucuucgcccacauccgcaagcgcggcgagucccgcgucuga

SEQ ID NO: 17635 - RNA, 807 nt, Artificial Sequence
  derived and/or modified sequence opt2 from capsid_protein_VP2__Norovirus__CRL46965
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccaaccuccagcaggccuccuuccagcacgacaaggagaugcuccaggcccagaucgaggccaccaagaagcuccagcaggagaugaugaaggucaagcaggccguccuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcgcccuccccggccgcgccaaccuccgcgacgccgcccccgcccgcggcuccuccuccaaguccuccaacuccuucaccgccaccuccgucuacuccaaccagaccaccuccacccgccucggcuccaccgccggcuccggcaccuccgucuccucccuccccuccaccgcccgcacccgcuccugggucgaggaccagucccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgccgccgcggcgagucccgcgucuga

SEQ ID NO: 17636 - RNA, 777 nt, Artificial Sequence
  derived and/or modified sequence opt2 from capsid_protein_VP2__Norovirus__CRL46968
auggccggcgccuuccucgccggccucgucggcgacgccaucaccuccggcgucggcucccucaucaacgccggcgccaacgccaucaaccagaaggucgaguacgacuucaacaagcagcuccagcucgccuccuucaagcacgacaaggagaugcuccagucccagguccucgccaccaagcagcuccagcaggagaugaugaacauccgccagggcguccucuccgccggcggcuucucccccaccgacgccgcccgcggcgccgucaacgcccccaugaccaagauccucgacuggaacggcacccgcuacuucgcccccaacuccaugaagaccaccuccuacuccggccaguucuccuccaaccccguccaccgccagcccaccuccccccgcuccgacccccccaagaucaaggucaacuccgacuccgccuccgucuacuccuccgccuccuccgcccccucccaguccacccacuccaccgcccucaccgccggcuccuccuccucccgcaccaccuccuccuccgccgccgccuccacccucucccgcaccuccgacuggguccgcggccagaacgagcgccucucccccuucauggacggcgcccuccagaccaccuucgucaccccccccuccuccaaggccuccuccuacggcuccgucuccaccguccccaaggccguccucgacuccuggacccccauguucaacacccaccgccagccccucuucgcccacguccgccgccgcggcgagucccagaucuga

SEQ ID NO: 17637 - RNA, 765 nt, Artificial Sequence
  derived and/or modified sequence opt2 from capsid_protein_VP2__Norovirus__CRL46971
auggccggcgccuucaucgccggccucgccggcgacaugcucaccaacaccgucggcucccucgucaacgccggcgccaacgccaucaaccagaccaucgaccucgagaacaacaaguaccuccagaacgccuccuucaaccacgacaaggagaugcucaacgcccagaucgaggccaccaagaagcuccaggccgacaugaucgccaucaagcagggcguccucaccgccggcggcuucucccccaccgacgccgcccgcggcgccaucaacgcccccaugaccaagguccucgacuggaacggcacccgccacugggcccccggcgccaccuccaccaccuccauguccggcggcuucacccaccagaccguccaccgcuccacccccaacuucaagaccaaccaggcccccaaguccacccccuccuccggcuccuccguccgcuccaacuccacccagaucaccucccucuccucccacuccuccggcuccucccgcuccuccggcuccaccgucauccgcuccauccccuccuccgaccgcacccgcgacugggucaaccagcagaacuucaaccucgagccccacaugcccggcucccuccgcaccgccuucgucaccccccccuccuccaccgccuccuccuccggcaccgucuccaccguccccaagaacguccucgacuccuggaccuccgccuucaacacccgccgccagccccucuucgcccaccuccgccgccgcggcgaguccaacgucuga

SEQ ID NO: 17638 - RNA, 771 nt, Artificial Sequence
  derived and/or modified sequence opt2 from capsid_protein_VP2__Norovirus__CRL46974
auggccggcgccuucgucgccggccucgccggcgacaucgucaccaacuccaucggcucccucgucaacgccggcgccaacgccaucaaccagaaggucgacuucgagaacaacaagcagcuccagcaggccuccuucaaccacgaccaggagaugcuccaggcccagauccaggccaccaagcagcuccaggccgacaugaucgcccuccgccagggcguccucaccgccggcggcuucucccccaccgacgccgcccgcggcgccgucaacgcccccaugacccagguccucgacugguccggcacccgcuacugggcccccggcgccaccaagaccaccgccuucuccggcggcuucaccuccucccccaacacccgcaccaucguccccaagaagaccuccgccacccccgccuccaccuccgucucccgccccuccucccucgccuccaccgccuccacccgcuccaccuucgucuccggcaccuccucccucuccuccuccacccgcuccuccuucaacucccagcccaccuccuccuccucccgcaccuccgaguggguccgcucccagaaccgcguccucgagcccuacaugcgcggcucccuccagaccgccuucgucaccccccccuccucccgcgccuccuccaacggcaccgucuccaccguccccaaggagguccucgacuccuggaccuccgucuucaacacccaccgccagccccucuucgcccaccuccgccgccgcggcgagucccaggucuga

SEQ ID NO: 17639 - RNA, 807 nt, Artificial Sequence
  derived and/or modified sequence opt2 from capsid_protein_VP2__Norovirus__CRL46977
auggccggcgccuucuucgccggccucgccuccgacguccucggcuccggccucggcucccucaucaacgccggcgccggcgccaucaaccagaaggucgaguucgagaacaaccgcaagcuccagcaggccuccuuccaguucuccuccucccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccgcccccgcccgcggcuccuccuccauguccuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgccuga

SEQ ID NO: 17640 - RNA, 807 nt, Artificial Sequence
  derived and/or modified sequence opt2 from capsid_protein_VP2__Norovirus__CRL46980
auggccggcgccuuccucgccggccucgccuccgacguccucggcuccggccucggcucccucaucaacgccggcgccggcgccaucaaccagaaggucgaguucgagaacaaccgcaagcuccagcaggccuccuuccaguucuccuccucccuccagcaggccuccuuccagcacgacaaggagaugcuccaggcccagaucgaggccaccaagaagcuccagcaggagaugaugcgcgucaagcaggccaugcuccucgagggcggcuucuccgagaccgacgccgcccgcggcgccaucaacgcccccaugaccaagacccucgacugguccggcacccgcuacugggcccccgacgcccgcaccaccaccuacaacgccggccgcuucuccaccccccagcccuccggcgcccuccccggccgcgccaaccuccgcgccaccgcccccgcccgcggcuccuccuccauguccuccaacuccuccaucgccaccuccgucuacuccaaccagaccaccuccacccgccucggcuccaccgccggcuccggcaccuccgucuccucccuccccuccaccgcccgcacccgcuccugggucgaggaccagaaccgcaaccucucccccuucaugcgcggcgcccacaacaucuccuucgucaccccccccuccucccgcuccuccucccagggcaccgucuccaccguccccaaggagguccucgacuccuggaccggcgccuucaacacccgccgccagccccucuucgcccacauccgcaagcgcggcgagucccgcgccuga

SEQ ID NO: 17641 - RNA, 1623 nt, Artificial Sequence
  derived and/or modified sequence opt3 from capsid_protein_VP1__Norovirus__ABY65350
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccagagcaguacagacacugaaaacgauuucgagacccaucaaaauacaaaguuuacuccagugggcgucauccaggacgggucuaccacacaccgaaacgaaccccagcaaugggugcucccguccuacagcggaagaaauguucacaacgugcaucuggccccugcaguagcuccaaccuuccccggcgagcaguuacuguuuuucaggucgacugucccugguuguucuggguaucccaauauggaucucgacugccuucugccacaggagugggugcagcacuuuuaccaagaagcggccccugcacaguccgauguugcuuugcuacgguucgugaaccccgacacgggccguguccuguuugaguguaaacuccauaagucaggauaugugacaguagcccacaccggccagcacgaucuggugauuccaccgaacggguacuuccgcuuugacaguuggguuaaucaguucuauacucuugcaccuaugggaaacgguaccggcagaaggcgggcccuguga

SEQ ID NO: 17642 - RNA, 1623 nt, Artificial Sequence
  derived and/or modified sequence opt3 from capsid_protein_VP1__Norovirus__ACO55068
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccgcugaagagauuccugccccacuggggacacccgauuucguaggacggauccagggcguucuuacccagacuacacgcggcgacgggucaacccgaggacauaaggcuacggugaguaccggugacguccacuuuacaccuaagcugggcagcauccaauucaacacugauaccaauaacgacuuugaaacagggcagaauacuaaguucaccccagugggagucgugcaggauggcaacgguacacaccaaaaugagccccagcaguggguuuugccgucuuacuccgggagaaccggccauaacgugcaccucgccccugcaguagccccaacuuuucccggagaacagcuguuauucuuuaggucaacgaugccuggcuguagcggguaccccaacaugaaucuggacugccuccuuccacaagaguggguccagcauuucuaucaggaggcugcgccugcacagagugauguggcccuguugcgguuuguuaaccccgacacaggacgugugcuauucgaauguaaacugcacaagucugguuacgucaccguggcucacacuggccaacaugaucucguaauuccaccgaauggguauuuucgcuucgacuccugggugaaccaguucuacacccuggccccuaugggaaauggcacagguagaaggcgggcacuuuga

SEQ ID NO: 17643 - RNA, 1623 nt, Artificial Sequence
  derived and/or modified sequence opt3 from capsid_protein_VP1__Norovirus__ADI45808
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucgcaucauaguugacgugcgacaacuggagccaguccuuaucccccugccugaugugcguaauaacuuuuaucauuacaaucagucgaacgacccaacaauuaaguugaucgcaaugcucuauacuccccugagagcuaacaaugccggggaugacguguucaccgucucaugcaggguucugacacggccgagcccugauuuugacuucauuuuucucgugcccccaaccguagaaagucgcacuaaaccuuucacagugcccaucuuaaccgucgaggaaaugacgaacuccagauuuccaauaccccuggagaggcuuuacacuggaccuucuagcgcguucgugguucagccacagaauggucgguguaccacagauggcguguugcuggggacuacccaacuauccgccgucaacauuugcacauuccgcggagacgugacccacaucgcaggcucacgaaauuauacgaugaaccucgcuagucagaauuggaacaauuacgauccgacugaggaaauucccgccccucuggguacaccagacuuuguagggaagauccagggaaugcuuacccagacuacaagaagcgacggcucuaccaggggccauaaagcuacgguucugaccggguccgccgauuucgcacccaaguugggacgggugcaauuugccacagacacugauaacgacuucgagucaggucagaauaccaaguuuacaccugucggcgugauccaggaugggagcacuacccaccguaacgaaccacaacaguggguccuccccaauuacaguggacgcacaggccauaacgugcaccuggcuccggcgguugcaccuaccuauccaggugagcaguuacuguucuuuagaucuacuaugcccggguguuccggcuacccuaauauggaccucgauugccuuauuccccaggacugggugcaacacuucuaucaggaagccgcuccagcccagagcgauguagcacuguugagguuugucaacccugacacgggacgggugcuauucgaguguaaacugcauaagucgggcuacguuacaguggcccacaccgggcagcaugaucucgucauacccccaaacggauauuuucgauucgacucuugggugaaucaauuuuacacucuggcuccgauggguaacggcaccgggcgcagaagggcccuuuga

SEQ ID NO: 17644 - RNA, 1623 nt, Artificial Sequence
  derived and/or modified sequence opt3 from capsid_protein_VP1__Norovirus__ADI45811
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagaucccuuggagcgccccacuuggacccgaucugaacccuuacuugucccacuuagcucggauguauaauggcuacgccgguggguucgaagugcaggucauucuggcgggaaacgcauuuacugccggcaaaaucauuuucgcugccgugccaccgaauuuucccacggagggccuaucuccuucgcagguaaccauguucccacauaucauaguugacgugcgccaacucgagcccguccugaucccucuuccagaugugcgaaacaauuuuuaucacuacaaccagucaaaugaccccacaauuaagcugaucgcaauguuguauacuccgcuccgugcuaacaacgccggggaugacguguucaccgucagcugcagaguucugacaaggccuagucccgauuuugacuucauuuuucuggugccaccuaccguagaaucccggacuaaacccuucucugugccaauccucacagucgaggaaaugaccaauagccgcuuucccauaccuuuagagaagcuguucacgggaccauccucagcguucgugguucagccgcagaacgguagauguacuaccgauggcgugcuuuuggggacaacucaacugagucccgucaauauuugcaccuuuaggggagacgugacacauaucaccggcagccggaacuacacgaugaaucuagccacucagaacuggaacucuuaugauccuacagaggaaauuccagcaccccucgguaccccugacuucguagggaaaauccagggaguucugacucagacaacccgcgcugacggcuccacgcgaggccacaaggccaccguguacacagggucagcugauuuugccccaaaacuuggaagaguccaauucgcaacugacaccgauaaugacuuugaugccaaucagaacacaaaguucacucccgugggugucauccaggacggcgauaccgcucauaggaaugagccgcaacagugggugcugccuagcuacagugggcggaacucucacaauguucacuuggcgccagcaguggcccccacauuuccuggagaacagcuccuguucuuucguuccaccaugcccggcuguagcgguuauccaaacauggacuuagauugccugcucccucaggaguggguacaauacuucuaucaggaagcugcccccgcacagucggacgucgcccuucugcgcuuugugaauccagauacugggagaguuuuguucgaguguaagcuacauaaaucuggcuacgugacggucgcucacacaggacagcaugaccuggugauuccgccuaacggcuauuuuagguucgacuccuggguaaaccaauucuacacccucgcccccauggggaauggaacuggucggcgacgcgcacuguga

SEQ ID NO: 17645 - RNA, 1623 nt, Artificial Sequence
  derived and/or modified sequence opt3 from capsid_protein_VP1__Norovirus__ADI45812
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuuacuccuaagcugggaagaguccaauucgccaccgacacagauaaugacuuugaugcaaaucagaacacuaaauucaccccagugggugucauccaggacggcaauacagcccauaggaacgagccccaacaguggguguugccgagcuacagugggcguaauucucacaacguucaccucgcuccugcgguggcaccaaccuuucccggagaacagcuguuauucuuucgguccacuaugccuggcuguagcgguuaucccaauauggaucuggacugccuccuuccacaggaguggguacaauacuucuaucaggaagccgcuccugcccagucggaugucgcacuguugcgcuuugugaaccccgacacggggagaguucuauucgaguguaagcugcauaaaucuggcuacgugacagucgcccacaccggacagcaugaucucgugauuccaccgaacggcuauuuuagguucgacuccuggguaaaucaauucuacacucuggcuccuauggggaacggaaccggucggcgacgcgcccuuuga

SEQ ID NO: 17646 - RNA, 1623 nt, Artificial Sequence
  derived and/or modified sequence opt3 from capsid_protein_VP1__Norovirus__ADI45814
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcagccggaacuacaccaugaaucucgcaacgcagaacuggaacucuuaugaucccacugaggaaauuccugcuccacuggguacacccgacuucguagggaagauccagggaguucuuacccagacuacacgcgccgacggcuccacccgaggccacaaggcuacgguguacaccgggucagccgauuuugcaccuaagcugggaagaguccaauucgccacagacacugauaaugacuuugaugcuaaucagaacaccaaauucacaccagugggugucauccaggacggcgauacugcgcauaggaaugagccccaacaguggguguugccgagcuacagugggcggaacucucacaauguucaccucgccccugcaguggcuccaaccuuucccggagaacagcuguuauucuuucguuccacaaugccuggcuguagcgguuaucccaacauggaccuggauugccuccuuccacaggaguggguacaauacuucuaucaggaagccgccccugcacagucggacgucgcucuguugcgcuuugugaaucccgauaccgggagaguucuauucgaguguaagcugcauaaaucuggcuacgugacugucgcccacacgggacagcaugaccucgugauuccaccgaacggcuauuuuagguucgacuccuggguaaaccaauucuacacacuggcaccuauggggaauggaaccggucggcgacgcgcgcuuuga

SEQ ID NO: 17647 - RNA, 1623 nt, Artificial Sequence
  derived and/or modified sequence opt3 from capsid_protein_VP1__Norovirus__ADI45815
augaagauggccagcuccgacgcuaaccccuucgauggcucuaccgcaaaucuggugccugaggucaacaaugaaguuauggcccucgagccagugguaggggcggcuaucgccgcaccgguggccggacagcaaaacgucauugaccccuggauaagaaauaacuuugugcaggcuccugguggcgaguucacaguuucaccaaggaaugcacccggggaaauccuuuggagugccccucugggaccagauuugaaccccuacuuaagccaccuggcucggauguauaauggcuacgccgguggguuugaagugcaggucauucuagcgggaaacgcauucacugccggcaaaaucauuuuugcugccgugccuccaaauuucccgacggagggccucucccccucucagguaaccauguuuccucauaucauaguugacgugcgccaacuggagccaguccuuaucccccugccugaugugcgaaacaauuucuaucacuacaaccagucgaaugacccaacaauuaaguugaucgcaaugcucuauacuccccugcgugcuaacaacgccggggaugacguguuuaccgucucaugcagaguucugacaaggccgagcccugauuucgacuuuauuuuccucgugcccccaaccguagaaagucggacuaaaccuuuuuccgugcccaucuuaacagucgaggaaaugaccaauucucgcuucccaauaccccuggagaaacuuuucacgggaccuagcuccgcguuugugguucagccacagaacgguagauguacuaccgauggcguguugcuggggacaacucaacuaucaccggucaauauuugcaccuucaggggagacgugacacauaucaccggcagucggaacuacacgaugaaucucgccacucagaacuggaauagcuaugaucccacagaggaaauuccugcaccacuggguacccccgacuuuguagggaagauccagggaguucuuacucagacaacccgcgcugacggcucuacgcgaggccacaaggccaccguguacacaggguccgcugauuucgccccuaagcugggaagaguccaauuugcaacugacaccgauaacgacuucgaugccaaucagaacacaaaauuuacuccagugggugucauccaggacggcaauaccgcucauaggaacgagccccaacaguggguguugccgucauacagcgggcggaauagucacaacguucaccucgcgccugcaguggccccaacauuccccggagaacagcuguuauuuuuccguucuaccaugccuggcuguuccgguuaucccaauauggaucuggacugccuccuuccacaggaguggguacaauacuuuuaucaggaagcugccccugcacagagcgaugucgcccuguugcgcuucgugaaccccgacacugggagaguucuauuugaguguaagcugcauaaaucgggcuacgugacggucgcucacacaggacagcaugaucucgugauuccaccgaacggcuauuucagguucgacucuuggguaaaucaauuuuacacccuggccccuauggggaacggaacuggucggcgacgcgcacuuuga

SEQ ID NO: 17648 - RNA, 1623 nt, Artificial Sequence
  derived and/or modified sequence opt3 from capsid_protein_VP1__Norovirus__ADI45816
augaagauggccagcaacgacgcuaaucccuccgauggcucugcagccaaccuggugccugagaucaauaacgaagucauggcgcucgagccaguugugggggcugccauugcagccccgguagcuggacagcaaaaugugauagaccccuggaucagaaacaauuucguccaggcaccugguggcgaauuuaccgugucaccaaggaacgcccccggggagauucuuuggagugcuccucugggaccagauuugaaucccuacuuaagccaccuggcccggauguauaacggcuacgcggguggguucgaaguucaggugaucccugcaggaaaugccuuuacagcuggcaaaauuaucuucgccgcagucccaccgaacuuucccacugagggccuauccccuucucaggugacgauguucccacauauaaucguagacguucgccaacucgagcccgugcugauuccucuuccagauguccgaaauaacuuuuaucacuacaaucagucgaacgacucaaccaucaagcugauugcuauguuguauacaccccuccgugccaacaaugcgggggaugacguguucacugugagcugcagaguccugaccaggccgaguccugauuuugacuucaucuuucugguucccccaacaguggaaucccggaccaaaccuuucacuguacccauacucacaguggaggaaaugaccaacucucgcuuuccaauucccuuagagaagcuguucacgggaccuagcuccgccuucgucgugcagccacagaaugguagauguacuaccgauggcguucuuuuggggacaacucaacugucaccggugaacaucugcaccuuuaggggagacgucacacauauugcaggcagucggaauuacaccaugaaccuagcuagccucaauuggaacaauuaugaucccacggaggaaaucccugccccacuggguacucccgacuucguggggaaaauccagggaguacuuacacagaccacuaaggaggacggcucuacacgcggccacaaggcuaccguuuacacgggguccgccgauuuuaccccuaaacugggaucagugcaguucgguacagacacugaaaacgauuuugagacccaucaaaauacaaaguucacuccagucggcgugauucaggacgggagcaccacacaccgaaacgaaccccagcaaugggucuugccgaguuacucuggaagaaaugugcacaacguucaucucgccccugcaguggcuccaaauuuucccggcgagcagcuguuauucuuuagguccaccaugccugguuguagcggguaucccaacauggaucuggacugccuccuuccacaggaguggguacagcacuucuaccaagaagcggccccugcacagucggaugucgcucuguugcgguuugugaaccccgacacuggccguguucuauucgaguguaaacugcauaagucuggauaugugacggucgcccacacaggccagcacgaucucgugauaccaccgaauggguacuuucgcuucgacuccuggguaaaccaguucuauacccuggcaccuaugggaaaugguacuggcagaaggcgggcccuuuga

SEQ ID NO: 17649 - RNA, 1623 nt, Artificial Sequence
  derived and/or modified sequence opt3 from capsid_protein_VP1__Norovirus__ADI45817
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucccgugccaccuaccguagaaagucggacuaaacccuucacagugccaauccucaccgucgaggaaaugacgaacucccgcuuucccauaccuuuagagagacuguacacuggaccaucuagcgcguucgugguucagccgcagaaugguagguguaccacagauggcgugcuuuuggggacuacccaacuguccgccgucaacauuugcacauuccggggagacgugacccauaucgcaggcucacgcaauuauacgaugaaccuagcuagucagaauuggaacaauuacgaucccacugaggaaauuccugccccacucgguacacccgacuuuguagggaagauccagggaaugcugacccagacuacacgaagcgacggcucuaccagaggccacaaagcuacgguucuuaccggguccgccgauuucgcaccuaagcugggaagggugcaauuugccacagacacugauaacgacuucgagucaggucagaauaccaaguuuacaccagucggcgugauccaggaugggagcacuacccaucggaacgaaccccaacagugggucuugccgaauuacaguggacguacaggccacaacgugcaccucgcuccugcgguugcaccaaccuaucccggugagcagcuguuauucuuucgcucuacuaugccuggguguuccggcuaccccaauauggaccuggauugccuccuuccacaggaaugggugcaacauuucuaucaggaggccgcuccugcccagagcgacguagcacuguugagauuugucaaccccgauacgggaagggugcuauucgaguguaaacugcacaagucgggcuacguuacaguggcccauaccgggcagcacgaccucgucauuccaccgaacggauauuuucgguucgauucuugggugaaucaauuuuacacucuggcuccuauggguaacggcaccgggcgacgcagagccguauga

SEQ ID NO: 17650 - RNA, 1623 nt, Artificial Sequence
  derived and/or modified sequence opt3 from capsid_protein_VP1__Norovirus__ADI45818
augaagauggccagcuccgacgcucaccccucugauggcucaaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucacaucauaguugacgugcgccaacuggagccaguccuuaucccccugccugaugugcgaaauaacuuuuaucauuacaaucagucaaacgacccaacaauuaaguugaucgcaaugcucuauacuccccugcgugcuaauaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgauggcgucuugcuggggacaacucaacuaaguccggugaacauaugcaccuuuaggggagacguaacacacauucccggcagccggaauuacaccaugaaccucgccucucagaauuggaacuccuaugauccuacggaggaaaucccagcaccccuggguacuccugacuucguugggaagauucagggagugcuuacacagaccacucgcacaaauggcucaacccgaggccauaaggcuacggucuacaccgggagcgccgacuuuaguccaaagcugggaagagugcaauucgcuacagauacugacaacgauuuugagaccaaucagaacacaaaauucacucccgucggugugauccaggacggcucuaccacaccgaggaaugaaccucaacaguggguuuugccauccuacagcgggcggaacauccacaaugugcaccucgcccccgcaguagccccuaccuuucccggagagcagcuguuauucuuucguucgacuaugccaggcuguucugguuauccuaacauggaucuggacugccuccuuccccaggaauggguccaauacuucuaucaggaggcugcgccagcacaguccgauguggcccuguugcgcuuuguuaauccggacacggggagagugcuauucgaguguaagcugcauaaaucaggcuacgucacaguggcuuauaccggacagcacgaucucguaauuccucccaacggcuacuuuagguucgacaguugggugaaccaauucuauacucuggccccaauggggaauggaaccggucggcgacgcgcacuuuga

SEQ ID NO: 17651 - RNA, 1626 nt, Artificial Sequence
  derived and/or modified sequence opt3 from capsid_protein_VP1__Norovirus__AET79296
augagaaugagcgacggcgccgcucccaaggcaaacggguccgaggccucuggacaggaucuggugccuaccgcggucgaacaagcuguuccaauccagccgguggccggugcaucacucgccgcucccgcagccggccagauuaaucagauagacccuuggaucuuccaaaacuuuguacagugcccacuuggggaguucaguauuagccccaggaauacaccuggagaaauccuguuugauuuggcuuuaggcccaggucugaaccccuaccuagcccaccucuccgcgauguauacugggugggugggaaauauggagguccagcuggugcuugcaggcaacgccuucacggcuggcaaaguuguggucgcccuggugccuccauacuuuccgaaggggucuuugaccacagcacagauuacuuguuucccccauguaaugugcgacguucggacccucgaaccuauccaacugccacugcucgaugugcgccgagucuuauggcacgcuacacaggaccaggaggagucgaugcgucugguguguaugcuuuauacccccuugagaacuaauucaccuggagaugagagcuuuguggucagugguaggcugcuauccaaaccagccgcggacuucaacuuuguuuaccucacacccccgauagaacggaccaucuaucgcaugguggaucugccuguacuucagcccagacugugcacgcaugccagguggccagcaccuguguacggcuugcucgucgaccccucucugccaagcaauccccaauggcagaacgggcgggugcacguugauggaacuuuacugggcaccacaccuguguccgguucaugggucaguuguuucgcugccgaagcugccuaugaguuucagagcgggacuggagagguggcaaccuucacacucauugaacaagacggcucugccuacguaccaggcgaucgcgcugcgccgcuuggguaccccgacuuuuccggacagcuggagaucgaaguucagaccgagacgacuaaggccggugacaaauugaaggugacaaccuucgaaaugauucuaggcccuacuacaaaugucgaucaggccccauaucaagggcgagugcaugcuucaaccagcgucacggccagucugaaccucguggacggaagaguuagggcagugccccggucuaucuacuccuuccaggauguagucccugaguauaaugacggccugcuugugccacuggcacccccgauagguccauuuuugccuggggagguucuccugcguuuccgcaccuacaugagacagauugauagcucggacgcugccgcagaagcgaucgauugcgcuuuaccccaggaguuuauuucuugguucgccuccaacgcauuuacagugcaaucagaagcccugcuacucagguaucggaauacucugaccggccagcuuuuguucgaguguaagcuguacagugaaggauauaucgcucucagcuacuccggcucugggccucugacauuucccacugacggauucuuugaggucgugagcuggguaccacgacuuuaccagcuggccucaguggguaguuuggcaaccggccgcacacucaaacaguga

SEQ ID NO: 17652 - RNA, 1626 nt, Artificial Sequence
  derived and/or modified sequence opt3 from capsid_protein_VP1__Norovirus__AFB18026
augagaaugagcgacggcgccacccccaagccuaacggguccgaggcugcaggacaggaucuggugccaucuucagucgaacaagccaucccgauucagcccguugcgggugcugccguggcagccccuacagcuggccagauaaaucagaucgacccauggauuuuccaaaacuuuguacagugcccccucggggaguucaguaucagcccuaggaauacuccaggagaaauucuuuuugaucuggcauugggccccgguuuaaacccuuaccuggcccaccuauccgcuauguauacggggugggugggaaauauggagguccagcucgugcuggccggcaacgcguucaccgcaggcaaaguuguggucgcccuugugccaccguacuuuccccaggggucucugacaacugcucaaaucaccuguuucccucauguaaugugcgacguucggacauuggaaccaauacagcucccccugcuggaugugcgccgaguccucuggcacgccacccagaaucaggaggaggcaaugcguuuaguguguaugcuguauacuccucuuagaacaaacucgccaggagacgaaucauuuguggucagcgguagguugcugagucggcccuccccggauuucaauuuuguuuaccuaaccccucccaucgagcgcacgauuuauagaaugguggaccucccaguagugcaaccuaggcugugcacucauucucgguggcccgcuccagucuaccagauccuuguggaucccagccugccuuccaacccacaguggcaaaauggccgcguuuugauugacgggacccuccugggaacaacuccgaucucaaguagcuggguggccucuuucgcgggcaccgccgaauauuccuuucagucacccccuagcgcagagauaggugaggucaguuuauucgaaauugaugggucugcuuacacaccaggagaccgagccgcuccccugggcuacccugauuuuuccggcacccucgagguggaaauccagacggagacuacaaaggccgggcagaaacuugacguacacaccuucaaccuggaacuuaagagccaaacuguugaccaggcaccauuccagggaaaaguguauauggaucuagaggccucggcuucucuggaccucgucaaugguagagugagggcgucaccccgguccgucgcagccuuuaaggaugagcugccgaguuacaacagcggccuucuggugccuuuggcuccaccccucgggccuuuccugcccggagaaguuuuacugcguuuucgcacauucgccagacagguggacaccacggaugcauccgcccaagcuguagacugugcccuaccacaggagcucgucucuugguuugcaagcucaaauuucaccgugcagagugaagcgcugcuuuugagguaucggaacacacugacuggccagcuccuguuugagugcaaguuguacuccgaagguuauauugcucugagcuacaccgggucuucaccuuugacauuccccacugauggcuuucucgagguugugaguugggucccacgacugcaucaauuagccagcgugggaucccuggcaaccggccgcucucuaaaacaguga

SEQ ID NO: 17653 - RNA, 1626 nt, Artificial Sequence
  derived and/or modified sequence opt3 from capsid_protein_VP1__Norovirus__AFB18027
augagaaugagcgacggcgccacccccaagccuaacggguccgaggcugcaggacaggaucuggugccaucuucagucgaacaagccaucccgauucagcccguugcgggugcugccguggcagccccuacagcuggccagauaaaucagaucgacccauggauuuuccaaaacuuuguacagugcccccucggggaguucaguaucagcccuaggaauacuccaggagaaauucuuuuugaucuggcauugggccccgguuuaaacccuuaccuggcccaccuauccgcuauguauacggggugggugggaaauauggagguccagcucgugcuggccggcaacgcguucaccgcaggcaaaguuguggucgcccuugugccaccguacuuucccaaggggucucugacaacugcucagaucaccuguuucccucauguaaugugcgacguucggacauuggaaccaauacaacucccccugcuggaugugcgccgaguccucuggcacgccacccaggaccaggaggaggcaaugcguuuaguguguaugcuguauacuccucuuagaacaaauucgccaggagaugaaucauuuguggucagcgguagguugcugagucggcccgcuuccgacuucaacuuuguuuaccuaaccccgccuaucgagcgcacgauuuauagaaugguggaucuccccguagugcagccaaggcugugcacucauucucgguggccugcccccgucuaccaaauccuuguggacccaagccugcccuccaauccucaguggcagaacggccgcguucaaguggaugggaccuugcucggaacaacuccagucucaggcaguuggguggcgagcuucgccgguaccgcagaauauucuuuucagacaccgcccuccgcugagauugggaccaucucacuguucgagauagacggaagcgccuacguaccuggcgaucgagcugccccauuaggcuaccccgacagugcagggacgcuggaaguugagauucagacugaaacaaccaaagccggacagaagcucaaugugcacacuuuuucucuugagcuggucucccaaacaguggaccaggcuccuuaucagggucagaucuucgucgauuuggaaaccagcucgucuauggaccuagugaacggcagaguuagggcguccccacggucaauuaguggguucaaagaugagcugcccagcuacaauaacggacuccuggugccgcuugcaccuccacugggccccuuuuugccuggugagguacuccugcguuuccgcacguuugccgggcaagucgacuuaaccgaugcugccgcacagcccguggacugugcccugccacaggaguucguuuccugguuugcuucuaauaacuucacagugcagagcgaagcccuacuccugagauauaggaacacucuuaccggccaauugcuguuugaaugcaagcucuacucagagggauauaucgcacugaguuacacaggcuccgggccucuuacuuuccccaccgauggauuuuucgaagucgugagcuggguaccacggcuguaucaguuggcgucuguggguucacucgcuacaggccgaagucugaagcaguga

SEQ ID NO: 17654 - RNA, 1635 nt, Artificial Sequence
  derived and/or modified sequence opt3 from capsid_protein_VP1__Norovirus__AFI08231
augaugauggccagcaaggacgcucccaccaacauggauggcacauccggggcaggacagcuggugccugaggccaauacugcggaaccaaucucuauggacccggucgcuggugccgcaacggccguugcuaccgcaggccaaauuaacaugauagaucccuggaucaugucaaauuucgugcaggccccucagggggaguuuacaguaaguccaaacaauacucccggagacgugcuguucgaucuucagcugggcccucaauugaacccauuuuuagcucaccuggcccagauguacaaugguugggucgggaacaugagagugaaaguucuacucgcgggaaaugcauucaccgccggcaagauuaucauuagcugcauacccccuggcuuuacaucccagaacaucucuaucgcucagaugaccauguucccacaugugauugccgacgucagggugcuggaaccgaucgagauuccccuugaagauguacggaauguucuguuucacacuaacgacaaucgcccuacaaugcgauugguguguaugcucuauaccccacugcgugcaaacgggucgucaagcggaacggaucccuucgucaucgcugguagagugcugacuugcccugacaguaauuuuuccuuccucuuuuuagugccacccaacgucgagcagaaaaccaggccguucucuguuccuaacauaccccugaauacacuuagcaacucccgggugccaucauugauuaagaguaugacuaucagccgcgaucaaaaucagauuauccaguuucaaaacggcagaguaacccuggacgggcagcuacagggaacaaccccuacgucugugucccaacucuguaaaaucaggggcacuacauaccaugccaccggugggaauggaauuaaccugacugagcuuaauggcgaacccuaucacgcguucgagucaccagcccccauaggcuucccugaucucgggggaugcgacuggcauuugacagcaaccccaacgcaggcuuuuaacgacggugccaaggucgugcggcucagcguuacccagggcgcugccuucgcaccgcaccuggggacaauccacuacacuaccacagauacugacuauaaucccaacaccaguauuaucuguacauuagauuggcugucucagaccgccggacaauccaauguggacccuuggcagauaccaacuuacggcagcacgcucacagaagcugcgcagcuugcacccccuauuuuuccacccgguuucggggagacccuggucuuuuucuugucggauuuuccgaucucuaacggcaagaauggacuauccgugccuugcacucugccacaggaguucguaacccauuuuguuaacgaacaagcccccauccgcggcgaggcugcccuccugcacuauguggacccugauacacaucgaaaucuuggggaguucaaacuguaccccgaaggauuuaugaccugugucccaaacacuucagguggcgggccucagacauugcccauuaacggaguguucgucuuugugaguuggguuagcagauucuaccagcucaagccagugggcacggccggugcagcuaggcggcuggggauccgucgcuccuga

SEQ ID NO: 17655 - RNA, 1623 nt, Artificial Sequence
  derived and/or modified sequence opt3 from capsid_protein_VP1__Norovirus__AFI08240
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggugcucccgagcuacagugguagagauguucacaacgugcaucuggccccugcaguagcuccaacuuuucccggggagcaguuacuguucuuuaggucuacgaugccuggcuguuccggauaucccaauauggaccucgauugccuucugccacaggaguggguccagcacuucuaccaagaagcggccccugcacagagcgacguggcuuugcuacgguuuguuaaccccgauacaggccgugugcuguucgaguguaaacuccauaagucgggguaugucaccguggcccacacuggacagcacgaccugguaauuccaccgaaugguuacuuucgcuucgauucuugggugaaccaguucuauacccuugcaccuaugggcaacgggacaggaagaaggcgggcccuguga

SEQ ID NO: 17656 - RNA, 1620 nt, Artificial Sequence
  derived and/or modified sequence opt3 from capsid_protein_VP1__Norovirus__AFS33552
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccagagccaugacaguaccuugaagcucauugcaaugcuguauacaccacugcgugcuaauaacgccggggaugacguguucacugucuccugcagaguucucaccaggcccucuccggauuuugacuucaucuuuuuagugccucccacaguagaaagccggaccaaaccauucacugugccuauucugacagucgaggaaauguccaacucacgcuuucccaucccacuugagaaguuguacaccggacccaguagcgcguucgugguucagccucagaaugguagauguacgacugauggcgugcugcuagggaccacacaacucucugccgucaacauaugcaauuucaggggagacgugacucacauuguaggcucccaugauuauaccaugaaccuggcaucacagaauuggagcaacuacgacccaacagaggaaaucccggcuccccuugguaccccugacuuuguugggaaaauucagggacuguugacgcagacuacacgggccgauggcaguacccgcgcucacaaggccacugugucuacaggcuccguccacuucaccccaaagcucgggagcgugcaauuuacgaccgacacaaauaacgauuuccagacuggacagaauaccaaauuuacacccgucggugugauccaagacggcgaucaucaccagaacgagccucagcaguggguucugccaaauuacucggggcgaacuggacauaacgugcacuuagcacccgccguagcuccgaccuucccuggcgaacaacugcucuuuuucagaucuacaaugccagguuguuccggguaucccaauaugaaccuugacugccuguugccucaggaguggguccuacacuuuuaccaggaagcggcacccgcccagucagauguggcucugcucagguucguuaauccagacaccggccgggugcuguuugaguguaaacuucauaagaguggauauaucacugucgcccacacgggcccuuacgaucuggugauucccccaaacggguauuuccguuuugacagcuggguaaaccaauucuacacauuggcaccgaugggaaaugguaccggccgcagaagggcccucuga

SEQ ID NO: 17657 - RNA, 1608 nt, Artificial Sequence
  derived and/or modified sequence opt3 from capsid_protein_VP1__Norovirus__AFS33555
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagauccuguugaauuuagaacugggaccugagcuaaacccauuccucgcccaccugagccggauguacaauggcuaugcugguggggucgaggugcagguucuucuggccggaaacgcguuuacggcaggcaaauugguguucgccgcuauucccccucauuuuccacucgaaaaucuguccccgggccagaucaccauguucccccacgucauuaucgaugugcgcacacuggagccuguacucuuaccacugcccgacguucgaaacaacuuuuuccauuacaaucagcaaccugaaccacguaugagacuuguggccauguuguauacuccccugaggucuaacgggucgggagaugacgucuuuaccgugucaugccgggugcuaacacgcccgagcccugauuucgacuuuaauuaccucguucccccaaccgucgagaguaagacuaaaccuuucacacugcccauacuuaccaucggugagcuguccaacucuagauuuccagugcccauugaugaauuguauacgagcccuaaugagggcguaaucgugcagccacagaacgggagguccacucucgacggagaacuguuaggcaccacacagcuggucccgucaaauauuugugcacuccggggucgcaucaacgcucaagugcccgaugaccaccaucaguggaaucuucagguuacuaacaccaaugggacaccuuucgauccaaccgaggacgugcccgccccucugggaacgccagacuucuuggcgaacauauacggcgucacaagucagcgaaaucccaacaauacuugcagagcccacgauggcgugcuagcaaccuggagcccgaaguuuacuccuaaacuggggucuguaauucucggaacaugggaagaguccgaccuggaucuuaaccaaccaaccagguucacgcccguuggucuguuuaauaccgaccacuucgaucagugggcuuugccuucauauagcggccggcucacacugaacaugaacuuagcccccagugugucuccacuguuuccuggggagcagcuacucuucuuucguucccauaucccccugaagggaggcacuagcgacggugcuauugauugucuuuugccacaagaauggauccagcacuucuaccaggagucggccccgucuccuaccgacgucgcacugauccgcuacacaaaucccgauacugggagagugcucuuugaagccaagcugcauaggcagggcuucauuaccgucgcuaacuccggaucacggccaauagugguucccccuaauggcuauuuucgauucgacaguugggugaaccaauuuuacagccuugcgccaauggggacaggaaauggucgcagaaggguacaguga

SEQ ID NO: 17658 - RNA, 1623 nt, Artificial Sequence
  derived and/or modified sequence opt3 from capsid_protein_VP1__Norovirus__AFW15938
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaaugcacagaacguucaccuggccccugcuguggcgccaaccuuucccggcgagcaguuacuguucuuuaggagcacuaugccugguuguucgggguaucccaauauggaucucgacugccuucugccacaggaguggguacaacauuucuaccaggaagcagccccugcucagucugaugucgccuugcuacgguuugugaaccccgacacgggccguguucuguucgaguguaaacuccacaaguccggauaugugacagucgcacauaccggccagcacgaucuggugauuccaccgaacggguacuuucgcuucgacucauggguaaaucaauucuauacucuugccccuaugggaaacgguaccggcagaaggcgggcucuguga

SEQ ID NO: 17659 - RNA, 1623 nt, Artificial Sequence
  derived and/or modified sequence opt3 from capsid_protein_VP1__Norovirus__AFW15940
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagaguccaaaaccaagccauucacugugccuaucuuaacagucgaagagaugaccaacucucgguuucccauaccacuggagaaacuuuucacgggacccagcuccgccuucgugguucagccucagaauggucgcuguacuaccgacggcguguugcuggggacaacucaacuaucaccagucaacauuugcaccuuuagaggagaugugacacauaucgcaggcaguaggaauuacaccaugaaccucgcuagccugaauuggaacaauuaugacccgacggaagagauucccgccccucuugguacuccagauuucguagggaagauccagggaguucugacacagaccacuaagggcgacggcucuacacgggggcacaaagcuaccguguacacgggauccgcccccuuuaccccuaaguuggguucaguccaguucagcacagacacugaaaacgauuuugagacccaucaaaauacaaaauucacuccagugggcgucauccaggacgggaguaccacacaccgcaacgaaccccagcaaugggugcucccgucuuacuccggacgaaaugcacagaacguucaccuggccccugcuguggcgccaaccuuucccggcgagcaguuacuguucuuuagaagcacuaugccugguuguucgggguaucccaauauggaucucgacugccuucugccacaggaguggguacaacauuucuaccaggaagcagccccugcucagucugaugucgccuugcuaagguuugugaaccccgacacgggccggguucuguucgaguguaagcuccacaaauccggauaugugacagucgcacauaccggccagcacgaucuggugauuccaccgaacggguacuuucguuucgacucauggguaaaucaauucuauacucuugccccuaugggaaacgguaccggccgcagaagggcucuguga

SEQ ID NO: 17660 - RNA, 1623 nt, Artificial Sequence
  derived and/or modified sequence opt3 from capsid_protein_VP1__Norovirus__AFW15941
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaauguucagaacgugcaccuggccccugcaguagcuccaaccuuucccggcgagcaguuacuguucuuuaggagcacuaugccugguuguucgggguaucccaauauggaucucgacugccuucugccacaggaguggguccaacauuucuaccaggaagcggccccugcacagucugauguggcuuugcuacgguuuguuaaccccgacacgggccgugugcuguucgaguguaaacuccacaaguccggauaugucacaguggcccauaccggccagcacgaucugguaauuccaccgaacggguacuuucgcuucgacucaugggugaaucaauucuauacucuugcaccuaugggaaacgguaccggcagaaggcgggcccuguga

SEQ ID NO: 17661 - RNA, 1623 nt, Artificial Sequence
  derived and/or modified sequence opt3 from capsid_protein_VP1__Norovirus__AFW15944
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggucaagcuaugaucccacggaggaaaucccugcaccacuggguacucccgacuucguugggaagauucagggagugcuuacacagaccacucgcacaaauggcaguacccgaggccacaaggcuacggucuacaccgggucugccgacuuuuccccuaagcugggaagagugcaauucgcuacagauacugacaacgauuuugagaccaaucagaacacaaaauucacuccagucggugugauccaggacggcagcaccacacccaggaaugaaccgcaacaguggguuuugccuucguacucugggcggaacauccauaaugugcaccucgccccagcaguagcccccaccuuuccuggagagcagcuguuauucuuucguuccacuaugcccggcuguucagguuauccaaacauggaucuggacugccuccuuccucaggaauggguccaauacuucuaucaggaggcugcgcccgcacagagugauguggcccuguugcgcuuuguuaauccagacacggggagagugcuauucgaguguaagcugcacaaaagcggcuacgucacaguggcucauaccggacagcacgaucucguaauuccgccuaacggcuauuuuagguucgacuccugggugaaccaauucuacacucuggcccccauggggaauggaaccggucggcgacgcgcacuuuga

SEQ ID NO: 17662 - RNA, 1623 nt, Artificial Sequence
  derived and/or modified sequence opt3 from capsid_protein_VP1__Norovirus__AFW15947
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugcuauucgaguguaagcugcacaaaaguggcuacgucacaguggcucauaccggacagcacgaucucguaauuccgccuaacggcuauuuuagguucgacagcugggugaaucaauucuacacucuggcccccauggggaacggaaccggucggcgacgcgcacuuuga

SEQ ID NO: 17663 - RNA, 1623 nt, Artificial Sequence
  derived and/or modified sequence opt3 from capsid_protein_VP1__Norovirus__AFW15948
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaaacgcguucguugugcagccucagaaugguagauguacuaccgauggcgucuugcuggggacaacucaacuaaguccagugaacauaugcaccuuuaggggagacguaacacauauuccgggcagccggaauuacaccaugaaccucgccucucagaauuggaacuccuaugaucccacggaggaaaucccugcaccacuggguacucccgacuucguugggaagauucagggagugcuuacacagaccacucgcacaaauggcucaacccgaggccacaaggcuacggucuacaccgggagcgccgacuuuaguccuaagcugggaagagugcaauucgcuacagauacugacaacgauuuugagaccaaucagaacacaaaauucacuccagucggugugauccaggacggcucuaccacacccaggaaugaaccgcaacaguggguuuugccuuccuacagcgggcggaacauccauaaugugcaccucgccccagcaguagcccccaccuuuccuggagagcagcuguuauucuuucguucgacuaugcccggcuguucugguuauccaaacauggaucuggacugccuccuuccucaggaauggguccaauacuucuaucaggaggcugcgcccgcacaguccgauguggcccuguugcgcuuuguuaacccagacacggggagagugcuauucgaguguaagcugcacaaaucaggcuacgucacaguggcucauaccggacagcacgaucucguaauuccgccuaauggcuauuuuagguucgacaguugggugaaccaauucuacacucuggcccccauggggaauggaaccggucggcgacgcgcacuuuga

SEQ ID NO: 17664 - RNA, 1623 nt, Artificial Sequence; identical to SEQ ID NO: 17662
  derived and/or modified sequence opt3 from capsid_protein_VP1__Norovirus__AFW15949

SEQ ID NO: 17665 - RNA, 1623 nt, Artificial Sequence
  derived and/or modified sequence opt3 from capsid_protein_VP1__Norovirus__AFW15950
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaaugugugcaccuuuaggggagacguaacacauauuucuggcucccggaacuacaccaugaaucucgccucacagaacuggacgagcuaugauccgacugaggaaauccccgcaccucuggguacaccagacuucguugggaagauucagggagugcuuacccagacuacacgcaccaauggcaguacgcgaggccacaaggcuaccgucuacacagggucugccgacuuuucccccaagcugggaagagugcaauucgcuacugauaccgacaacgauuuugagacaaaucagaacacuaaauucaccccugucggugugauccaggacggcagcacaaccccaaggaaugaaccccaacaguggguuuugccgucguacucugggcggaacauccauaaugugcaccucgccccugcaguagccccaacuuuucccggagagcagcuguuauucuuucguuccacgaugccuggcuguucagguuaucccaacauggaucuggacugccuccuuccacaggaauggguccaauacuucuaucaggaggcugcgccugcacagagugauguggcccuguugcgcuuuguuaaucccgacacagggagagugcuauucgaguguaagcugcacaaaagcggcuacgucaccguggcucauacuggacagcacgaucucguaauuccaccgaacggcuauuuuagguucgacuccugggugaaccaauucuacacccuggccccuauggggaauggaacaggucggcgacgcgcacuuuga

SEQ ID NO: 17666 - RNA, 1623 nt, Artificial Sequence
  derived and/or modified sequence opt3 from capsid_protein_VP1__Norovirus__AFW15951
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucucuggcucccggaacuacaccaugaaucucgccucacagaacuggacgagcuaugauccgacugaggaaauucccgcaccucuggguacaccagacuucguagggaagauccagggaguucuuacccagacuacacgcaccaauggcaguacgcgaggccacaaggcuaccguguacacagggucugccgacuuuucccccaagcugggaagaguccaauucgcuacugauaccgacaacgauuuugagacaaaucagaacacuaaauucaccccugugggugucauccaggacggcagcacaaccccaaggaaugaaccccaacaguggguguugccgucguacucugggcggaacauucauaauguucaccucgccccugcaguggccccaacuuuucccggagagcagcuguuauucuuucguuccacgaugccuggcuguucagguuaucccaacauggaucuggacugccuccuuccacaggaauggguacaauacuucuaucaggaggcugcgccugcacagagugaugucgcccuguugcgcuuugugaaucccgacacagggagaguucuauucgaguguaagcugcacaaaagcggcuacgugaccgucgcucauacuggacagcacgaucucgugauaccaccgaacggcuauuuuagguucgacuccuggguaaaccaauucuacacccuggccccuauggggaauggaacaggucggcgacgcgcacuuuga

SEQ ID NO: 17667 - RNA, 1653 nt, Artificial Sequence
  derived and/or modified sequence opt3 from capsid_protein_VP1__Norovirus__AFX71665
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaggaugucuuuacaguuucaugucgcguguuaacuagaccagcccccgacuucgaguuuaccuuccugguaccgccuacaguggaaagcaagaccaaacccuuuacucuuccaauuuugacacugggcgagcuaaguaacuccagguucccugcggccaucgauaugcucuauaccgaccccaaugaaucuauugucgugcaaccacagaacgggcggugcacgcuggauggaacucuucaggguaccacacagcugguucccacucaaaucugugcauuucgcggcaccuugauaagccagacagcucgagccgcugacuccaccgauucaccucagagagccaggaaucacccacuccaugugcaagucaagaaccuggacgggacgcaguacgauccgacugacgacauucccgcaguguuaggagccaucgauuuccagggcacaguauucgguguugcuagucagcgggacgugagcgggcaacaggagcagggacacuaugcgacccgugcacacgaagcccauauugauacuacagacccuaaauacgcuccaaagcugggcaccauccucaucaagucugauuccgacgauuuuaauacgaaccagcccauucgcuucaccccugucggcaugggggacaauaacuggagacaaugggagcuuccagauuacucaggaaggcugacauugaauaugaaccuagcccccgcagugagcccgaguuuuccuggugagcggauacuguucuuucgaucuaucgucccauccgccggcggguauggaagcggcuacauugacugccucaucccccaggaaugggugcagcacuucuaucaggaggcugccccuucgcaaucugcaguugcgcuggugcgcuacguaaaucccgauacugguagaaacauauuugaagcuaaacuucauagggagggguuccugaccgucgccaauuccggcaacaauccaauugugguuccucccaacggauauuuucgguucgaagcaugggugaaccaguuuuacacauuggccccaaugggcucagggcagggacgcagaagggcucaguga

SEQ ID NO: 17668 - RNA, 1623 nt, Artificial Sequence
  derived and/or modified sequence opt3 from capsid_protein_VP1__Norovirus__AFX71668
augaagauggccagcuccgacgcuucucccucagauggcaguaccgcaaaccuggugccugaggucaauaacgaaguuauggcccucgagccaguggcgggggcugccaucgcagccccgguagcuggacagcaaaaugugauugaccccuggauaagaaacaauuucguccaggcaccugguggcgaauuuacagugagcccaaggaacgcccccggggagauccuuugguccgcuccucugggaccagauuugaaucccuacuuaucucaccuggcccggauguauaacggcuacgcggguggguucgaaguucaggugauucuagcaggaaaugccuuuacugcuggcaaaaucauuuucgccgcagucccuccaaacuuuccgacggagggccucucgcccucacaggugaccauguucccucauaucauaguagacguucgccaacuggagccagugcuuaucccccugccugauguccgaaauaacuuuuaucacuacaaucaguugaacgacccaacaauuaagcucaucgcuaugcuguauacuccccugcgugccaauaacgcgggggaugacguguucaccgugagcugcagaguccucacaaggccgaguccugauuuugacuucaucuuuuuaguucccccaaccguggaaucccggacuaaaccuuucucuguacccgugcugacagucgaggaaaugaccaacagccgcuuuccaauuccccuugagaaguuguucacgggaccuuccucagccuucgugguucagccacagaaugguagauguacuaccgauggcgugcugcuagggacaacucaacucaguccggucaacauaugcaccuuuaggggagacgugacacauauuagcggcucucggaauuacaccaugaaccuggcaucccagaauuggaacucauaugaucccacggaggaaaucccugcuccacuugguacucccgacuucguagggaaaauucagggaguucugacacagaccacucgcacaaauggcagcacccgaggccacaaggccacgguguacaccgggagugcugacuuuucuccuaaguugggaagaguccaauucgccacagauacugacaacgauuuugagaccaaucagaacacaaaauucacuccagugggugucauccaggacggcaauaccacacccaggaacgaaccgcaacagugggugcucccuuccuacagcgggcggaauauccagaacguucaucuggcaccagccguggcucccaccuuuccuggagagcaguuacuguucuuucguucgacuaugcccggcuguucugguuauccaaauauggaucucgacugccuucugccucaagaauggguacaguacuucuaucaggaggcggcacccgcccaguccgaugucgcuuugcuacgcuuugugaacccagacacggggagaguucuguucgaguguaagcuccacaaaucaggcuacgugacagucgcccacaccggacaacaugaucuggugauuccgccuaacggcuauuuuagguucgacaguuggguaaaucaguucuacacucuugcacccauggggaacggaaccggucggcgacgcgcccuguga

SEQ ID NO: 17669 - RNA, 1623 nt, Artificial Sequence; identical to SEQ ID NO: 17655
  derived and/or modified sequence opt3 from capsid_protein_VP1__Norovirus__AFX81121

SEQ ID NO: 17670 - RNA, 1623 nt, Artificial Sequence; identical to SEQ ID NO: 17655
  derived and/or modified sequence opt3 from capsid_protein_VP1__Norovirus__AFX81127

SEQ ID NO: 17671 - RNA, 1623 nt, Artificial Sequence; identical to SEQ ID NO: 17655
  derived and/or modified sequence opt3 from capsid_protein_VP1__Norovirus__AFX81130

SEQ ID NO: 17672 - RNA, 1623 nt, Artificial Sequence; identical to SEQ ID NO: 17655
  derived and/or modified sequence opt3 from capsid_protein_VP1__Norovirus__AFX81136

SEQ ID NO: 17673 - RNA, 1623 nt, Artificial Sequence; identical to SEQ ID NO: 17655
  derived and/or modified sequence opt3 from capsid_protein_VP1__Norovirus__AFX81139

SEQ ID NO: 17674 - RNA, 1623 nt, Artificial Sequence; identical to SEQ ID NO: 17655
  derived and/or modified sequence opt3 from capsid_protein_VP1__Norovirus__AFX81142

SEQ ID NO: 17675 - RNA, 1623 nt, Artificial Sequence; identical to SEQ ID NO: 17655
  derived and/or modified sequence opt3 from capsid_protein_VP1__Norovirus__AFX81145

SEQ ID NO: 17676 - RNA, 1623 nt, Artificial Sequence; identical to SEQ ID NO: 17655
  derived and/or modified sequence opt3 from capsid_protein_VP1__Norovirus__AFX81148

SEQ ID NO: 17677 - RNA, 1623 nt, Artificial Sequence; identical to SEQ ID NO: 17655
  derived and/or modified sequence opt3 from capsid_protein_VP1__Norovirus__AFX81154

SEQ ID NO: 17678 - RNA, 1623 nt, Artificial Sequence; identical to SEQ ID NO: 17655
  derived and/or modified sequence opt3 from capsid_protein_VP1__Norovirus__AFX81157

SEQ ID NO: 17679 - RNA, 1623 nt, Artificial Sequence; identical to SEQ ID NO: 17655
  derived and/or modified sequence opt3 from capsid_protein_VP1__Norovirus__AFX81163

SEQ ID NO: 17680 - RNA, 1623 nt, Artificial Sequence
  derived and/or modified sequence opt3 from capsid_protein_VP1__Norovirus__AFX81166
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguuccuaaugugcaccuggcaccagccguagcucccaccuuuccuggugagcaguuacuguucuuuaggagcacuaugcccggguguucgggcuauccaaacauggaucucgacugccuucugccucaggaguggguccagcauuucuaccaagaagcggcacccgcccagucugauguggcuuugcuacgguuuguuaauccagacacgggacgugugcuguucgaguguaaacuccacaaguccggcuaugucacaguggcccauaccgggcagcacgaucugguaauuccgccuaacggauacuuucgcuucgacucaugggugaaccaguucuauacucuugcacccauggguaauggcaccgggagaaggcgggcccuguga

SEQ ID NO: 17681 - RNA, 1623 nt, Artificial Sequence; identical to SEQ ID NO: 17655
  derived and/or modified sequence opt3 from capsid_protein_VP1__Norovirus__AFX81169

SEQ ID NO: 17682 - RNA, 1623 nt, Artificial Sequence; identical to SEQ ID NO: 17655
  derived and/or modified sequence opt3 from capsid_protein_VP1__Norovirus__AFX81172

SEQ ID NO: 17683 - RNA, 1623 nt, Artificial Sequence; identical to SEQ ID NO: 17655
  derived and/or modified sequence opt3 from capsid_protein_VP1__Norovirus__AFX81178

SEQ ID NO: 17684 - RNA, 1623 nt, Artificial Sequence; identical to SEQ ID NO: 17655
  derived and/or modified sequence opt3 from capsid_protein_VP1__Norovirus__AFX81181

SEQ ID NO: 17685 - RNA, 1623 nt, Artificial Sequence; identical to SEQ ID NO: 17655
  derived and/or modified sequence opt3 from capsid_protein_VP1__Norovirus__AFX81190

SEQ ID NO: 17686 - RNA, 1623 nt, Artificial Sequence; identical to SEQ ID NO: 17655
  derived and/or modified sequence opt3 from capsid_protein_VP1__Norovirus__AFX81193

SEQ ID NO: 17687 - RNA, 1623 nt, Artificial Sequence; identical to SEQ ID NO: 17655
  derived and/or modified sequence opt3 from capsid_protein_VP1__Norovirus__AFX81196

SEQ ID NO: 17688 - RNA, 1623 nt, Artificial Sequence
  derived and/or modified sequence opt3 from capsid_protein_VP1__Norovirus__AFX81199
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacgggacuacacgaugaaccucgcuagucugaauuggaacaauuaugauccgacugaagagauucccgccccucuugggacaccagacuucguaggaaagauccagggcguucugacccagacuacaaagggcgacgggagcacccgcggacacaaggcuacgguguacaccgguucugcccccuuuacaccuaaauugggcuccguccaguucucaacugauaccgaaaacgacuuugagacacaucaaaauacuaaguucaccccagugggggucauccaggauggaggcacaacccaccgaaacgaaccccagcaaugggugcucccgagcuacagugguagagacguucacaaugugcaucuggccccugcaguagcuccaacuuuucccggggagcaguuacuguucuuuaggucuacgaugccuggcuguuccggauaucccaacauggaucucgacugccuucugccacaggaguggguccagcacuucuaccaagaagcggccccugcacagagcgauguggcuuugcuacgguuuguuaaucccgacacaggccgugugcuguucgaguguaaacuccauaagucgggguaugucaccguggcccacacuggacagcacgaucugguaauuccaccgaacgguuacuuucgcuucgacucuugggugaaucaguucuauacccuugcaccuaugggcaacgggacaggaagaaggcgggcccuguga

SEQ ID NO: 17689 - RNA, 1623 nt, Artificial Sequence; identical to SEQ ID NO: 17655
  derived and/or modified sequence opt3 from capsid_protein_VP1__Norovirus__AFX81202

SEQ ID NO: 17690 - RNA, 1623 nt, Artificial Sequence
  derived and/or modified sequence opt3 from capsid_protein_VP1__Norovirus__AFX81205
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggcacucccgagcuacagugguagagaugugcacaacguucaucuggccccugcuguggcgccaacuuuucccggggagcaguuacuguucuuuaggucuacgaugccuggcuguuccggauaucccaauauggaccucgauugccuucugccacaggaguggguacagcacuucuaccaagaagcagccccugcucagagcgacgucgccuugcuacgguuugugaaccccgauacaggccguguucuguucgaguguaaacuccauaagucgggguaugugaccgucgcacacacuggacagcacgaccuggugauuccaccgaaugguuacuuucgcuucgauucuuggguaaaccaguucuauacccuugccccuaugggcaacgggacaggaagaaggcgggcucuguga

SEQ ID NO: 17691 - RNA, 1623 nt, Artificial Sequence; identical to SEQ ID NO: 17655
  derived and/or modified sequence opt3 from capsid_protein_VP1__Norovirus__AFX81208

SEQ ID NO: 17692 - RNA, 1623 nt, Artificial Sequence; identical to SEQ ID NO: 17655
  derived and/or modified sequence opt3 from capsid_protein_VP1__Norovirus__AFX81211

SEQ ID NO: 17693 - RNA, 1623 nt, Artificial Sequence; identical to SEQ ID NO: 17655
  derived and/or modified sequence opt3 from capsid_protein_VP1__Norovirus__AFX81214

SEQ ID NO: 17694 - RNA, 1623 nt, Artificial Sequence; identical to SEQ ID NO: 17655
  derived and/or modified sequence opt3 from capsid_protein_VP1__Norovirus__AFX81226

SEQ ID NO: 17695 - RNA, 1623 nt, Artificial Sequence
  derived and/or modified sequence opt3 from capsid_protein_VP1__Norovirus__AFX81229
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugagucucgcuagccugaauuggaacaauuaugacccgacugaagagauucccgccccucuugggacaccagauuucguaggaaagauccagggcguucugacccagacuacaaagggcgacgggucuacccgcggacacaaggcuacgguguacaccgguuccgcccccuuuacaccuaaauugggcucaguccaguucagcacugacaccgaaaacgauuuugagacacaucaaaauacuaaguucaccccagugggggucauccaggacggaggcacaacccaccgaaacgaaccccagcaaugggugcucccgaguuacucugguagagauguucacaaugugcaucuggccccugcaguagcuccaacuuuucccggggagcaguuacuguucuuuagguccacgaugccuggcuguagcggauaucccaacauggaccucgauugccuucugccacaggaguggguccagcacuucuaccaagaagcggccccugcacagucggacguggcuuugcuacgguuuguuaaucccgauacaggccgugugcuguucgaguguaaacuccauaagucuggguaugucaccguggcccacacuggacagcacgaccugguaauuccaccgaacgguuacuuucgcuucgauuccugggugaaucaguucuauacccuugcaccuaugggcaacgggacaggaagaaggcgggcccuguga

SEQ ID NO: 17696 - RNA, 1623 nt, Artificial Sequence; identical to SEQ ID NO: 17655
  derived and/or modified sequence opt3 from capsid_protein_VP1__Norovirus__AFX81232

SEQ ID NO: 17697 - RNA, 1623 nt, Artificial Sequence; identical to SEQ ID NO: 17655
  derived and/or modified sequence opt3 from capsid_protein_VP1__Norovirus__AFX81238

SEQ ID NO: 17698 - RNA, 1623 nt, Artificial Sequence
  derived and/or modified sequence opt3 from capsid_protein_VP1__Norovirus__AFX81241
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugcuauucgaguguaagcugcacaaaaguggcuacgucacaguggcucauaccggacagcacgaucucguaauuccgccuaacggcuauuuuagguucgacagcugggugaaucaauucuacacucuggcccccauggggaacggaaccggucggcgacgcgcacuuuga

SEQ ID NO: 17699 - RNA, 1623 nt, Artificial Sequence
  derived and/or modified sequence opt3 from capsid_protein_VP1__Norovirus__AFX81247
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacugggauuccuaugacccuacggaggaaacuccagcaccccuggguacaccugacuucguugggaagauccagggagugcuuacccagacuacacgcaccaauggcucaacgcgaggccacaaggcuaccgucuacacagggagcgccgauuuuaguccaaagcugggaagagugcaauucgcuacugacaccgauaacgacuuugagacaaaucagaacacuaaauucacccccgucggugugauucaggauggcucuacaaccccgaggaaugaaccucaacaguggguuuugccauccuacagcgggcggaacauccauaaugugcaccucgcccccgcaguagccccuacuuuucccggagagcagcuguuauucuuucguucgacgaugccaggcuguucugguuauccuaacauggaccuggauugccuccuuccccaggaauggguccaauacuucuaucaggaggcugcgccagcacaguccgacguggcccuguugcgcuuuguuaauccggauacagggagagugcuauucgaguguaagcugcacaaaucaggcuacgucaccguggcucauacuggacagcacgaccucguaaucccucccaacggcuauuuuagguucgauaguugggugaaccaauucuacacccuggccccaauggggaauggaacaggucggcgacgcgcacuuuga

SEQ ID NO: 17700 - RNA, 1623 nt, Artificial Sequence
  derived and/or modified sequence opt3 from capsid_protein_VP1__Norovirus__AFX81250
augaagauggccagcuccgacgcuaaccccucuaauggcucaaccgcaaaccuggugccugaggucaauaacgaaguuauggcccucgagccagugguaggggcggcuaucgccgcaccgguggccggacagcaaaaugucauugaucccuggauaagaaacaauuucgugcaggcuccugguggcgaauuuacaguuaguccaaggaacgcacccggggagauccuuuggagcgccccucugggaccagacuugaaucccuacuuaucccaccuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucauaucauaguugaugugcgccaacuggagccaguccuuaucccccugccugacgugcgaaauaacuuuuaucacuacaaucagucaaacgauccaacaauuaaguugaucgcaaugcucuauacuccccugcgugcuaacaaugccggggacgauguguucaccgucagcugcagaguucugacaaggccgaguccugacuuugauuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgacggcgucuugcuggggacaacucaacuaaguccggugaacauaugcaccuuuaggggagauguaacacauauucccagcucucacaauuacaccaugaaccucgccucccagaauuggaacucauaugacccuacggaggaaaucccagcaccccugggcacuccugauuucguugguaagauucagggggugcuuacacagaccacucggacagacggaagcacccgcggccauaaggcuacggucuacaccggcagugccgacuuuucuccaaagcuggggcgagugcaauucgcuacagauacugacaaugauuuucagaccaaccagaauacaaaauucacucccgucggagugauccaagacgguuccaccacaccgagaaacgagccucagcaguggguuuugccaagcuacucgggcaggaauauccacaacgugcaccucgcccccgcaguagccccuaccuuucccggggaacagcuguuauucuuucggucuacuaugccaggauguuccggcuauccuaauauggaucuggacugccuccuuccccaagaguggguccaguacuucuaucaggaagcugcgccagcacagucagauguggcccuguugcguuuuguuaacccggacacgggucgcgugcuauucgaguguaagcugcauaaaaguggguacgucacaguggcucacaccggccaacaugaucucguaauuccucccaacggauauuuuagauucgacagcugggugaaucaguucuacacucuggccccaaugggcaacgggaccggaaggcggcgagcacuuuga

SEQ ID NO: 17701 - RNA, 1623 nt, Artificial Sequence; identical to SEQ ID NO: 17698
  derived and/or modified sequence opt3 from capsid_protein_VP1__Norovirus__AFX81253

SEQ ID NO: 17702 - RNA, 1623 nt, Artificial Sequence
  derived and/or modified sequence opt3 from capsid_protein_VP1__Norovirus__AFX81256
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggaauauccauaacgugcaccucgcccccgcaguagccccuaccuuucccggagagcagcuguuauucuuucguucgacuaugccaggcuguucugguuauccuaauauggaucuggacugccuccuuccccaggaauggguccaauacuucuaucaggaggcugcgccagcacaguccgauguggcccuguugcgcuuuguuaacccggacacggggagagugcuauucgaguguaagcugcacaaaucaggcuacgucacaguggcucauaccggacagcacgaucucguaauuccucccaacggcuauuuuagguucgacaguugggugaaucaauucuacacucuggccccaauggggaacggaaccggucggcgacgcgcacuuuga

SEQ ID NO: 17703 - RNA, 1623 nt, Artificial Sequence; identical to SEQ ID NO: 17655
  derived and/or modified sequence opt3 from capsid_protein_VP1__Norovirus__AFX81262

SEQ ID NO: 17704 - RNA, 1623 nt, Artificial Sequence; identical to SEQ ID NO: 17655
  derived and/or modified sequence opt3 from capsid_protein_VP1__Norovirus__AFX81265

SEQ ID NO: 17705 - RNA, 1623 nt, Artificial Sequence
  derived and/or modified sequence opt3 from capsid_protein_VP1__Norovirus__AFX81268
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcgcgucauucuagcaggaaacgccuuuacagcuggcaaaaucauuuucgccgcagugccuccaaauuuuccgacugagggccucucucccucgcagguaacgauguucccucauaucauaguugacgugcgacagcuggagccaguccuuaucccccugccugaugugcguaacaauuuuuaucacuacaaccaaaccaaugacucaacaauuaaguugaucgcuaugcucuauacuccacugagagccaacaacgcgggggaagauguguucaccgucagcugcaggguucugacacggcccaguccggacuuugauuucauuuuucucgugccucccaccguagagucccgcacuaaaccauucacagugccuaucuuaaccgucgaagagaugacuaauucuagauuucccauaccacuggagaaacuuuucacgggacccagcggugccuucgugguucagccucagaacgggagguguaccacagacggcguguugcugggaacuacccagcuauccccagucaauauuugcacauuucggggcgaugugacccauaucgcagguucacgcaacuacacgaugaaucucgcuagucugaacuggaauaacuaugacccgacugaagagauucccgccccucuugggacaccagauuucguaggaaagauccaaggcguucugacccagacuacaaagggcgacgggagcacccgaggacacaaggcuacgguguacaccgguucugcccccuuuacaccuaaauugggcuccguccaguucucaacugacaccgaaaaugauuuugagacacaucagaacacuaaguucaccccagugggggucauccaagacggaggcacaacccacagaaaugaaccccagcagugggugcucccgagcuacagugguagggauguucacaacgugcaucuggccccugcaguagcuccaacuuuucccggggagcaauuacuguucuuucggucuacgaugccuggcuguuccggauaucccaauauggaccucgauugccuucugccacaggaguggguccagcacuucuaccaggaagcggccccugcacaaagcgacguggcuuugcuacguuuuguuaaccccgauacaggccgcgugcuguucgaguguaaacuccauaagucgggguaugucaccguggcccacacuggacagcacgaccugguaauuccaccgaaugguuacuuuagauucgauucuugggugaaccaguucuauacccuugcaccuaugggcaacgggacaggaaggcggcgagcccuguga

SEQ ID NO: 17706 - RNA, 1623 nt, Artificial Sequence; identical to SEQ ID NO: 17655
  derived and/or modified sequence opt3 from capsid_protein_VP1__Norovirus__AFX81271

SEQ ID NO: 17707 - RNA, 1623 nt, Artificial Sequence
  derived and/or modified sequence opt3 from capsid_protein_VP1__Norovirus__AFX81274
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcgcgucauucuagcaggaaacgccuuuacagcuggcaaaaucauuuucgccgcagugccuccaaauuuuccgacugagggccucucucccucgcagguaacgauguucccucauaucauaguugacgugcgacagcuggagccaguccuuaucccccugccugaugugcguaacaauuuuuaucacuacaaccaaaccaaugacucaacaauuaaguugaucgcuaugcucuauacuccacugagagccaacaacgcgggggaagauguguucaccgucagcugcaggguucugacacggcccaguccggacuuugauuucauuuuucucgugccucccaccguagagucccgcacuaaaccauucacagugccuaucuuaaccgucgaagagaugacuaauucuagauuucccauaccacuggagaaacuuuucacgggacccagcggugccuucgugguucagccucagaacgggagguguaccacagacggcguguugcugggaacuacccagcuauccccagucucaauuugcacauuucggggcgaugugacccauaucgcagguagucgcaauuacacgaugaaccucgcuagccugaauuggaacaauuaugacccgacugaagagauucccgccccucuugggacaccagauuucguaggaaagauccaaggcguucugacccagacuacaaagggcgacgggucuacccgaggacacaaggcuacgguguacaccgguuccgcccccuuuacaccuaaauugggcucaguccaguucagcacugacaccgaaaacgauuuugagacacaucagaauacuaaguucaccccagugggggucauccaagacggaggcacaacccacagaaacgaaccccagcagugggugcucccgaguuacucugguagggauguucacaaugugcaucuggccccugcaguagcuccaacuuuucccggggagcaauuacuguucuuucgguccacgaugccuggcuguagcggauaucccaacauggaccucgauugccuucugccacaggaguggguccagcacuucuaccaggaagcggccccugcacaaucggacguggcuuugcuacguuuuguuaaucccgauacaggccgcgugcuguucgaguguaaacuccauaagucuggguaugucaccguggcccacacuggacagcacgaccugguaauuccaccgaacgguuacuuuagauucgauuccugggugaaucaguucuauacccuugcaccuaugggcaacgggacaggaaggcggcgagcccuguga

SEQ ID NO: 17708 - RNA, 1623 nt, Artificial Sequence; identical to SEQ ID NO: 17705
  derived and/or modified sequence opt3 from capsid_protein_VP1__Norovirus__AFX81277

SEQ ID NO: 17709 - RNA, 1623 nt, Artificial Sequence
  derived and/or modified sequence opt3 from capsid_protein_VP1__Norovirus__AFX81283
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaagcacaacccaccgaaaugaaccccagcaaugggugcucccgaguuacucuggcagagauguucacaacgugcaucuggccccugcaguagcuccaacuuuucccggugagcaguuacuguucuuuagguccacgaugccuggguguagcggcuaucccaauauggaccucgauugccuucugccacaggaguggguccagcacuucuaccaagaagcggccccugcacagucggacguggcuuugcuacgguuuguuaaccccgauacaggacgugugcuguucgaguguaaacuccauaagucuggcuaugucaccguggcccacacugggcagcacgaccugguaauuccaccgaauggauacuuucgcuucgauuccugggugaaccaguucuauacccuugcaccuauggguaacggcacagggagaaggcgggcccuguga

SEQ ID NO: 17710 - RNA, 1623 nt, Artificial Sequence; identical to SEQ ID NO: 17655
  derived and/or modified sequence opt3 from capsid_protein_VP1__Norovirus__AFX81289

SEQ ID NO: 17711 - RNA, 1623 nt, Artificial Sequence; identical to SEQ ID NO: 17655
  derived and/or modified sequence opt3 from capsid_protein_VP1__Norovirus__AFX81292

SEQ ID NO: 17712 - RNA, 1623 nt, Artificial Sequence; identical to SEQ ID NO: 17655
  derived and/or modified sequence opt3 from capsid_protein_VP1__Norovirus__AFX81295

SEQ ID NO: 17713 - RNA, 1623 nt, Artificial Sequence; identical to SEQ ID NO: 17655
  derived and/or modified sequence opt3 from capsid_protein_VP1__Norovirus__AFX81298

SEQ ID NO: 17714 - RNA, 1623 nt, Artificial Sequence
  derived and/or modified sequence opt3 from capsid_protein_VP1__Norovirus__AFX81301
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggucuaccacacaccgaaaugaaccccagcaaugggugcucccguccuacagcggaagaaacguuccuaaugugcaccuggcaccagccguagcucccaccuuuccuggcgagcaguuacuguucuuuaggucgacuaugcccgguuguucuggguauccaaacauggaucucgacugccuucugccucaggaguggguccagcauuucuaccaagaagcggcacccgcccaguccgauguggcuuugcuacgguuuguuaauccagacacgggccgugugcuguucgaguguaaacuccacaagucaggauaugucacaguggcccauaccggccagcacgaucugguaauuccgccuaacggguacuuucgcuucgacaguugggugaaccaguucuauacucuugcacccaugggaaaugguaccggcagaaggcgggcccuguga

SEQ ID NO: 17715 - RNA, 1623 nt, Artificial Sequence; identical to SEQ ID NO: 17655
  derived and/or modified sequence opt3 from capsid_protein_VP1__Norovirus__AFX81304

SEQ ID NO: 17716 - RNA, 1623 nt, Artificial Sequence; identical to SEQ ID NO: 17655
  derived and/or modified sequence opt3 from capsid_protein_VP1__Norovirus__AFX81307

SEQ ID NO: 17717 - RNA, 1623 nt, Artificial Sequence; identical to SEQ ID NO: 17655
  derived and/or modified sequence opt3 from capsid_protein_VP1__Norovirus__AFX81313

SEQ ID NO: 17718 - RNA, 1623 nt, Artificial Sequence; identical to SEQ ID NO: 17655
  derived and/or modified sequence opt3 from capsid_protein_VP1__Norovirus__AFX81316

SEQ ID NO: 17719 - RNA, 1623 nt, Artificial Sequence; identical to SEQ ID NO: 17655
  derived and/or modified sequence opt3 from capsid_protein_VP1__Norovirus__AFX81319

SEQ ID NO: 17720 - RNA, 1623 nt, Artificial Sequence; identical to SEQ ID NO: 17655
  derived and/or modified sequence opt3 from capsid_protein_VP1__Norovirus__AFX81322

SEQ ID NO: 17721 - RNA, 1623 nt, Artificial Sequence; identical to SEQ ID NO: 17655
  derived and/or modified sequence opt3 from capsid_protein_VP1__Norovirus__AFX81325

SEQ ID NO: 17722 - RNA, 1623 nt, Artificial Sequence; identical to SEQ ID NO: 17655
  derived and/or modified sequence opt3 from capsid_protein_VP1__Norovirus__AGE89433

SEQ ID NO: 17723 - RNA, 1623 nt, Artificial Sequence; identical to SEQ ID NO: 17655
  derived and/or modified sequence opt3 from capsid_protein_VP1__Norovirus__AGE89436

SEQ ID NO: 17724 - RNA, 1623 nt, Artificial Sequence; identical to SEQ ID NO: 17702
  derived and/or modified sequence opt3 from capsid_protein_VP1__Norovirus__AGE89439

SEQ ID NO: 17725 - RNA, 1623 nt, Artificial Sequence
  derived and/or modified sequence opt3 from capsid_protein_VP1__Norovirus__AGE89442
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauucccggcucucggaauuacaccaugaaccucgccucccagaauuggaacucauaugauccuacggaggaaaucccagcaccccuggguacuccugacuucguugggaagauucagggagugcuuacacagaccacucgcacagacggcagcacccgaggccacaaggcuacggucuacaccgggagugccgauuuuucuccaaagcugggaagagugcaauucgcuacagacacugauaaugacuuugagaccaaccagaauacaaaauucacucccgucggugugauccaggauggcuccaccacacauaggaacgaaccgcaacaguggguuuugccuagcuacucggggcgggacgugcacaauguacaccucgccccagcagucgcccccaccuuuccuggagagcagcuguuauucuuucguucuacuaugcccggcuguuccgguuauccaaacauggaucuggacugccuccuuccucaggaaugggugcaauacuucuaucaggaggcugcgcccgcacagucagauguugcccuguugcgcuuugugaauccagacacggggagaguccuauucgaguguaagcugcauaaaaguggcuacgugacaguagcucacaccggacagcaugaucucgugaucccgccuaacggcuauuuuagguucgacagcuggguuaaucaauucuacacucuggcccccauggggaacggaaccggucggcgacgcgcacuuuga

SEQ ID NO: 17726 - RNA, 1623 nt, Artificial Sequence
  derived and/or modified sequence opt3 from capsid_protein_VP1__Norovirus__AGE89445
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauucccggcucucggaauuacaccaugaaccucgccucccagaauuggaacucauaugauccuacggaggaaaucccagcaccccuggguacuccugacuucguugggaagauucagggagugcuuacacagaccacucgcacaaauggcagcacccgaggccacaaggcuacggucuacaccgggagugccgacuuuucuccaaagcugggaagagugcaauucgcuacagauacugacaacgauuuugagaccaaucagaacacaaaauucacucccgucggugugauccaggacggcuccaccacaccgaggaaugaaccucaacaguggguuuugccaagcuacucggggcggaacauccauaaugugcaccucgcccccgcaguagccccuaccuuucccggagagcagcuguuauucuuucguucuacuaugccaggcuguuccgguuauccuaacauggaucuggacugccuccuuccccaggaauggguccaauacuucuaucaggaggcugcgccagcacagucagauguggcccuguugcgcuuuguuaauccggacacggggagagugcuauucgaguguaagcugcacaaaaguggcuacgucacaguggcucauaccggacagcacgaucucguaauuccucccaacggcuauuuuagguucgacagcugggugaaccaauucuacacucuggccccaauggggaauggaaccggucggcgacgcgcacuuuga

SEQ ID NO: 17727 - RNA, 1623 nt, Artificial Sequence; identical to SEQ ID NO: 17702
  derived and/or modified sequence opt3 from capsid_protein_VP1__Norovirus__AGE89448

SEQ ID NO: 17728 - RNA, 1623 nt, Artificial Sequence; identical to SEQ ID NO: 17655
  derived and/or modified sequence opt3 from capsid_protein_VP1__Norovirus__AGE89451

SEQ ID NO: 17729 - RNA, 1623 nt, Artificial Sequence
  derived and/or modified sequence opt3 from capsid_protein_VP1__Norovirus__AGE89454
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggggagcuccucugggcccagauuugaaccccuacuuaagccaccuggcccggauguauaaugguuacgcagggggauucgaagugcaggucauucuagcaggcaacgccuuuacagcuggcaaaaucauuuucgccgcagugccuccaaauuuuccgacugaggggcucucccccucucagguaacgauguucccucauaucauaguugacgugcgccaacuggagccaguccuuaucccccugccugaugugcgaaacaauuuuuaucacuacaaccagaccaaugacucgacaauuaaguugaucgcuaugcucuauacuccacugcgugccaacaacgcgggagaagauguguucaccgucucaugcagaguucugacaaggcccagcccggacuuugauuucauuuuucucgugccucccaccguagagagucggacuaaaccauucacagugccuaucuuaaccgucgaagagaugacuaauucccgcuuucccauaccacuggagaaacuuuucacgggucccucuggcgccuucgugguucagccucagaacgggagauguaccacagacggaguguugcugggcacuacccaacuaagcccagucaauauuugcacauuuaggggugaugugacccauaucgcagggucccggaacuacacgaugaaucucgcuucacugaacuggaauaacuaugacccgacugaagagauucccgccccucuuggaacaccagauuucguaggcaagauccagggcguucugacccagacuacaaagggggacggaaguacccgcggucacaaggcuacgguguacaccggcagcgcccccuuuacaccuaaauuggggucuguccaguucuccacugacaccgaaaaugauuuugagacacaucaaaacacuaaguucaccccagugggagucauccaggacggcgguacaacccaccgaaaugaaccccagcaaugggugcucccgucauacagcgggagagauguucacaacgugcaucuggcgccugccguagcuccaacuuuucccggcgagcaguuacuguucuuuaggaguacgaugccuggauguucuggcuaucccaauauggaccucgauugccuucugccacaggaguggguccagcacuucuaccaagaagcggccccugcacaguccgacguggcuuugcuacgguuuguuaaccccgauacagggcgugugcuguucgaguguaaacuccauaagagcggauaugucaccguggcccacaauggucagcacgaccugguaauuccaccgaacggcuacuuucgcuucgauucgugggugaaccaguucuauacucuugcaccuauggggaauggaaccggcagaaggcgggcccuguga

SEQ ID NO: 17730 - RNA, 1623 nt, Artificial Sequence; identical to SEQ ID NO: 17655
  derived and/or modified sequence opt3 from capsid_protein_VP1__Norovirus__AGE89457

SEQ ID NO: 17731 - RNA, 1623 nt, Artificial Sequence; identical to SEQ ID NO: 17655
  derived and/or modified sequence opt3 from capsid_protein_VP1__Norovirus__AGE89460

SEQ ID NO: 17732 - RNA, 1623 nt, Artificial Sequence; identical to SEQ ID NO: 17655
  derived and/or modified sequence opt3 from capsid_protein_VP1__Norovirus__AGE89463

SEQ ID NO: 17733 - RNA, 1623 nt, Artificial Sequence; identical to SEQ ID NO: 17655
  derived and/or modified sequence opt3 from capsid_protein_VP1__Norovirus__AGE89466

SEQ ID NO: 17734 - RNA, 1623 nt, Artificial Sequence; identical to SEQ ID NO: 17729
  derived and/or modified sequence opt3 from capsid_protein_VP1__Norovirus__AGE89472

SEQ ID NO: 17735 - RNA, 1623 nt, Artificial Sequence; identical to SEQ ID NO: 17705
  derived and/or modified sequence opt3 from capsid_protein_VP1__Norovirus__AGE89475

SEQ ID NO: 17736 - RNA, 1623 nt, Artificial Sequence; identical to SEQ ID NO: 17655
  derived and/or modified sequence opt3 from capsid_protein_VP1__Norovirus__AGE89478

SEQ ID NO: 17737 - RNA, 1623 nt, Artificial Sequence
  derived and/or modified sequence opt3 from capsid_protein_VP1__Norovirus__AGE89481
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaaggaagacggcagcacccgcgggcacaaggcuacgguguacaccggaucugcccccuuuacaccuaaauuggguuccguccaguucucaacugacaccgagaaugauuuugaaacacaucaaaacacuaaguucaccccagugggcgucauccaggacgggggaacaacccaccgaaaugagccccagcaaugggugcucccgagcuacaguggcagagauguucacaacgugcaucuggccccugcaguagcuccaacuuuucccggugagcaguuacuguucuuuaggucuacgaugccuggguguuccggcuaucccaauauggaccucgauugccuucugccacaggaauggguccagcacuucuaccaagaggcggccccugcacagagcgacguggcuuugcuacgguuuguuaaccccgauacaggacgugugcuguucgaauguaaacuccauaagucgggcuaugucaccguggcccacacugggcagcacgaccugguaauuccaccgaauggauacuuucgcuucgauucuugggugaaccaguucuauacccuugcaccuauggguaacggcacagggagaaggcgggcccuguga

SEQ ID NO: 17738 - RNA, 1623 nt, Artificial Sequence; identical to SEQ ID NO: 17655
  derived and/or modified sequence opt3 from capsid_protein_VP1__Norovirus__AGE89490

SEQ ID NO: 17739 - RNA, 1623 nt, Artificial Sequence; identical to SEQ ID NO: 17655
  derived and/or modified sequence opt3 from capsid_protein_VP1__Norovirus__AGE89493

SEQ ID NO: 17740 - RNA, 1623 nt, Artificial Sequence
  derived and/or modified sequence opt3 from capsid_protein_VP1__Norovirus__AGE89496
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggugcucccgagcuacagugguagagauguucacaacgugcaucuggccccugcaguagcuccaacuuuucccggggagcaguuacuguucuuuaggucuacgaugccuggcuguuccggauaucccaauauggaccucgauugccuucugccacaggaguggguccagcacuucuaccaagaagcggccccugcacagagcgacguggcuuugcuacgguuuguuaaccccgauacaggccgugugcuguucgaguguaaacuccauaagccaggguaugucaccguggcccacacuggacagcacgaccugguaauuccgccuaaugguuacuuucgcuucgauucgugggugaaccaguucuauacccuugcacccaugggcaacgggacaggaagaaggcgggcccuguga

SEQ ID NO: 17741 - RNA, 1623 nt, Artificial Sequence; identical to SEQ ID NO: 17655
  derived and/or modified sequence opt3 from capsid_protein_VP1__Norovirus__AGE89499

SEQ ID NO: 17742 - RNA, 1623 nt, Artificial Sequence
  derived and/or modified sequence opt3 from capsid_protein_VP1__Norovirus__AGE89502
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcgcauuuaggggcgaugugacacauaucgcugguucacggaacuacaccaugaaucucgccagucugaacuggaauaacuaugacccgacggaagagauucccgcuccucuugggacuccagauuucguaggaaagauccagggcguucugacacagaccacuaagggcgacgggagcacacgcggacacaaggccaccguguacacggguucugcacccuuuaccccuaaauugggcuccguccaguucucaacagacacugaaaaugauuuugagacccaucaaaacacaaaguucacuccagugggggucauccaggacggaggcaccacacaccgaaaugaaccccagcaaugggugcucccgagcuacagugguagagauguucacaacgugcaucuggccccugcuguagcgccaaccuuucccggggagcaguuacuguucuuuaggucuacuaugccuggcuguuccggauaucccaauauggaccucgauugccuucugccacaggaguggguccagcacuucuaccaagaagcagccccugcucagagcgacguggccuugcuacgguuuguuaaccccgauacgggccgugugcuguucgaguguaaacuccauaagucgggguaugucacaguggcacacaccggacagcacgaccugguaauuccaccgaaugguuacuuucgcuucgauucuugggugaaccaguucuauacucuugccccuaugggcaacgggaccggaagaaggcgggcucuguga

SEQ ID NO: 17743 - RNA, 1623 nt, Artificial Sequence; identical to SEQ ID NO: 17655
  derived and/or modified sequence opt3 from capsid_protein_VP1__Norovirus__AGE89505

SEQ ID NO: 17744 - RNA, 1623 nt, Artificial Sequence
  derived and/or modified sequence opt3 from capsid_protein_VP1__Norovirus__AGE89508
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacgggacuacaccaugaaucucgcuagucugaacuggaauaacuaugauccgacggaagagauucccgccccucuugggacuccagacuucguaggaaagauccagggcguucugacacagaccacuaagggcgacgggagcacacgcggacacaaggcuaccguguacacggguucugcccccuuuaccccuaaauugggcuccguccaguucucaacagauacugaaaaugacuuugaggcacaucaaaacaccaaguucacaccagugggggucauccaggauggaggcacuacccaccgaaaugaaccccagcaaugggugcucccgagcuacagugguagagacguucacaacgugcaucuggccccugcuguagcgccaacauuucccggggagcaguuacuguucuuuaggucuaccaugccuggcuguuccggauaucccaauauggaucucgacugccuucugccacaggaguggguccagcacuucuaccaagaagcagccccugcucagagcgauguggccuugcuacgguuuguuaaccccgacacuggccgugugcuguucgaguguaaacuccauaagucgggguaugucacgguggcacacacaggacagcacgaucugguaauuccaccgaaugguuacuuucgcuucgacucuugggugaaccaguucuauacccuugccccuaugggcaacgggacuggaagaaggcgggcucuguga

SEQ ID NO: 17745 - RNA, 1623 nt, Artificial Sequence; identical to SEQ ID NO: 17655
  derived and/or modified sequence opt3 from capsid_protein_VP1__Norovirus__AGE89511

SEQ ID NO: 17746 - RNA, 1623 nt, Artificial Sequence; identical to SEQ ID NO: 17655
  derived and/or modified sequence opt3 from capsid_protein_VP1__Norovirus__AGE89514

SEQ ID NO: 17747 - RNA, 1623 nt, Artificial Sequence; identical to SEQ ID NO: 17655
  derived and/or modified sequence opt3 from capsid_protein_VP1__Norovirus__AGE89517

SEQ ID NO: 17748 - RNA, 1623 nt, Artificial Sequence; identical to SEQ ID NO: 17742
  derived and/or modified sequence opt3 from capsid_protein_VP1__Norovirus__AGE89520

SEQ ID NO: 17749 - RNA, 1623 nt, Artificial Sequence; identical to SEQ ID NO: 17655
  derived and/or modified sequence opt3 from capsid_protein_VP1__Norovirus__AGE89523

SEQ ID NO: 17750 - RNA, 1623 nt, Artificial Sequence; identical to SEQ ID NO: 17655
  derived and/or modified sequence opt3 from capsid_protein_VP1__Norovirus__AGE89526

SEQ ID NO: 17751 - RNA, 1623 nt, Artificial Sequence; identical to SEQ ID NO: 17737
  derived and/or modified sequence opt3 from capsid_protein_VP1__Norovirus__AGE89529

SEQ ID NO: 17752 - RNA, 1623 nt, Artificial Sequence; identical to SEQ ID NO: 17655
  derived and/or modified sequence opt3 from capsid_protein_VP1__Norovirus__AGE89532

SEQ ID NO: 17753 - RNA, 1623 nt, Artificial Sequence; identical to SEQ ID NO: 17705
  derived and/or modified sequence opt3 from capsid_protein_VP1__Norovirus__AGE89535

SEQ ID NO: 17754 - RNA, 1623 nt, Artificial Sequence
  derived and/or modified sequence opt3 from capsid_protein_VP1__Norovirus__AGE89538
augaagauggccagcaacgacgcuaaucccuccgauggcucugcagccucacuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagaccaacgacagcacaauuaaguugaucgcuaugcucuauacuccacugcgugccaauaacgcgggggaagauguguucaccgucaguugcagaguucugacaaggcccuccccggacuuugauuucauuuuucucgugccucccaccguagagucucggacuaaaccauucacagugccuaucuuaaccgucgaagagaugacgaacagccgcuuucccauaccacuggagaaacuuuucacuggacccuccggugccuucgugguucagccucagaauggcagauguaccacagacgggguguugcugggaacuacccaacuaucaccagucaacauuugcacauuuaggggcgaugugacccauaucgcagguagucggaauuacacgaugaaccucgcuagccugaauuggaacaauuaugacccgacugaagagauucccgccccucuugggacaccagauuucguaggaaagauccagggcguucugacccagacuacaaagggcgacgggucuacccgcggacacaaggcuacgguguacaccgguuccgcccccuuuacaccuaaauugggcucaguccaguucagcacugacaccgaaaacgauuuugagacacaucaaaauacuaaguucaccccagugggggucauccaggacggaggcacaacccaccgaaacgaaccccagcaaugggugcucccgaguuacucugguagagauguucacaaugugcaucuggccccugcaguagcuccaacuuuucccggggagcaguuacuguucuuuagguccacgaugccuggcuguagcggauaucccaacauggaccucgauugccuucugccacaggaguggguccagcacuucuaccaagaagcggccccugcacagucggacgcugccuugcuacgguuugugaaucccgauacaggccguguucuguucgaguguaaacuccauaagucuggguaugugaccgucgcacacacuggacagcacgaccuggugauuccaccgaacgguuacuuucgcuucgauuccuggguaaaucaguucuauacccuugccccuaugggcaacgggacaggaagaaggcgggcucuguga

SEQ ID NO: 17755 - RNA, 1623 nt, Artificial Sequence; identical to SEQ ID NO: 17655
  derived and/or modified sequence opt3 from capsid_protein_VP1__Norovirus__AGE89541

SEQ ID NO: 17756 - RNA, 1623 nt, Artificial Sequence; identical to SEQ ID NO: 17655
  derived and/or modified sequence opt3 from capsid_protein_VP1__Norovirus__AGE89544

SEQ ID NO: 17757 - RNA, 1623 nt, Artificial Sequence; identical to SEQ ID NO: 17709
  derived and/or modified sequence opt3 from capsid_protein_VP1__Norovirus__AGE89547

SEQ ID NO: 17758 - RNA, 1623 nt, Artificial Sequence; identical to SEQ ID NO: 17688
  derived and/or modified sequence opt3 from capsid_protein_VP1__Norovirus__AGE89550

SEQ ID NO: 17759 - RNA, 1623 nt, Artificial Sequence
  derived and/or modified sequence opt3 from capsid_protein_VP1__Norovirus__AGE89553
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugaggcacaucaaaauaccaaguucacaccagugggggucauccaggacggaggcacuacccaccgaaacgaaccccagcaaugggugcucccgagcuacagugguagagauguucacaaugugcaucuggccccugcuguagcgccaacauuucccggggagcaguuacuguucuuuaggucuaccaugccuggcuguuccggauaucccaacauggaccucgauugccuucugccacaggaguggguccagcacuucuaccaagaagcagccccugcucagagcgacguggccuugcuacgguuuguuaaucccgauacuggccgugugcuguucgaguguaaacuccauaagucgggguaugucacgguggcacacacaggacagcacgaccugguaauuccaccgaacgguuacuuucgcuucgauucuugggugaaccaguucuauacccuugccccuaugggcaaugggacuggaagaaggcgggcucuguga

SEQ ID NO: 17760 - RNA, 1623 nt, Artificial Sequence; identical to SEQ ID NO: 17737
  derived and/or modified sequence opt3 from capsid_protein_VP1__Norovirus__AGE89556

SEQ ID NO: 17761 - RNA, 1623 nt, Artificial Sequence
  derived and/or modified sequence opt3 from capsid_protein_VP1__Norovirus__AGE89559
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaaggaagacggcagcacccgcgggcacaaggcuacgguguacaccggaucugcccccuuuacaccuaaauuggguuccguccaguucucaacugacaccgagaaugauuuugaaacacaucaaaacacuaaguucaccccagugggcgucauccaggacgggggaacaacccaccgaaaugagccccagcaaugggugcucccgagcuacaguggcagagauguucacaacgugcaucuggccccugcaguagcuccaacuuuucccggugagcagauuuuauucuuuaggucuacgaugccuggguguuccggcuaucccaauauggaccuggauugccuccuuccacaggaauggguccagcacuucuaccaagaggcggccccugcacagagcgacguggcucuguugcgguuuguuaaccccgauacaggacgugugcuauucgaauguaaacugcauaagucgggcuaugucaccguggcccacacugggcagcacgaccucguaauaccaccgaauggauacuuucgcuucgauucuugggugaaccaguucuauacccuggcaccuauggguaacggcacagggagaaggcgggcccuuuga

SEQ ID NO: 17762 - RNA, 1623 nt, Artificial Sequence
  derived and/or modified sequence opt3 from capsid_protein_VP1__Norovirus__AGE89562
augaagauggccagcaacgacgcuaaucccuccgauggcucugcagccucacuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagaccaacgacccaacaauuaaguugaucgcuaugcucuauacuccccugcgugccaauaacgcgggggaagauguguucaccgucagcugcagaguucugacaaggccgaguccugacuuugauuucauuuuucucgugcccccaaccguagagucccggacuaaaccuuucacagugcccaucuuaaccgucgaagagaugacgaacucucgcuuuccaauaccccuggagaaacuuuucacuggaccuagcggugccuucgugguucagccacagaauggcagauguaccacagacgggguguugcugggaacuacccaacuauccccggucaacauuugcacauuuaggggcgaugugacccauaucgcagguucacggaauuacacgaugaaccucgcuagucugaauuggaacaauuaugaccccacugaagagauuccugccccacuugggacacccgauuucguaggaaagauccagggcguucugacccagacuacaaagggcgacgggagcacccgcggacacaaggcuacgguguacaccgguucugccccuuuuacaccaaaauugggcuccguccaguucucaacugacaccgaaaacgauuuugagacacaucaaaauacuaaguucacccccgugggggucauccaggacggaggcacaacccaccgaaacgaaccgcagcaaugggugcucccuagcuacagugguagagauguucacaaugugcaucuggcaccagccguagcucccacuuuuccuggggagcaguuacuguucuuuaggucuacgaugcccggcuguuccggauauccaaacauggaccucgauugccuucugccucaggaguggguccagcacuucuaccaagaagcggcacccgcccagagcgacguggcuuugcuacgguuuguuaauccagauacaggccgugugcuguucgaguguaaacuccauaagucgggguaugucaccguggcccacacuggacagcacgaccugguaauuccgccuaacgguuacuuucgcuucgauucuugggugaaucaguucuauacccuugcacccaugggcaacgggacaggaagaaggcgggcccuguga

SEQ ID NO: 17763 - RNA, 1623 nt, Artificial Sequence
  derived and/or modified sequence opt3 from capsid_protein_VP1__Norovirus__AGE89565
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagacacccgccccucuugggaccccagauuucguaggaaagauucagggcguucugacucagacaaccaagggcgacgggagcacgcgcggacacaaggcuaccguguacacagguucugcccccuuuacuccuaaauugggcuccguccaguucucaaccgacacagaaaaugauuuugagacucaucaaaacaccaaguucacaccagugggggucauccaggacggaggcaccacucaccgaaaugaaccccagcaaugggugcucccgagcuacagugguagagauguucacaacgugcaucuggccccugcaguagcuccaacguuucccggggagcaguuacuguucuuuaggucuacaaugccuggcuguuccggauaucccaauauggaccucgauugccuucugccacaggaguggguccagcacuucuaccaagaagcggccccugcacagagcgacguggcuuugcuacgguuuguuaaccccgauaccggccgugugcuguucgaguguaaacuccauaagucgggguaugucacuguggcccacaccggacagcacgaccugguaaucccaccgaaugguuacuuucgcuucgauucuugggugaaccaguucuauacacuugcaccuaugggcaacgggaccggaagaaggcgggcccuguga

SEQ ID NO: 17764 - RNA, 1623 nt, Artificial Sequence; identical to SEQ ID NO: 17655
  derived and/or modified sequence opt3 from capsid_protein_VP1__Norovirus__AGE89568

SEQ ID NO: 17765 - RNA, 1623 nt, Artificial Sequence; identical to SEQ ID NO: 17655
  derived and/or modified sequence opt3 from capsid_protein_VP1__Norovirus__AGE89571

SEQ ID NO: 17766 - RNA, 1623 nt, Artificial Sequence; identical to SEQ ID NO: 17655
  derived and/or modified sequence opt3 from capsid_protein_VP1__Norovirus__AGE89574

SEQ ID NO: 17767 - RNA, 1623 nt, Artificial Sequence; identical to SEQ ID NO: 17655
  derived and/or modified sequence opt3 from capsid_protein_VP1__Norovirus__AGE89577

SEQ ID NO: 17768 - RNA, 1623 nt, Artificial Sequence; identical to SEQ ID NO: 17688
  derived and/or modified sequence opt3 from capsid_protein_VP1__Norovirus__AGE89580

SEQ ID NO: 17769 - RNA, 1623 nt, Artificial Sequence; identical to SEQ ID NO: 17655
  derived and/or modified sequence opt3 from capsid_protein_VP1__Norovirus__AGE89583

SEQ ID NO: 17770 - RNA, 1623 nt, Artificial Sequence
  derived and/or modified sequence opt3 from capsid_protein_VP1__Norovirus__AGE89586
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacccaacaauuaaguugaucgcuaugcucuauacuccccugcgugccaacaacgcgggggaagauguguucaccgucucaugcagaguucugacaaggccgagcccugacuuugauuucauuuuucucgugcccccaaccguagagagucggacuaaaccuuucacagugcccaucuuaaccgucgaagagaugacuaauucccgcuuuccaauaccccuggagaaacuuuucacgggaccuucuggugccuucgugguucagccacagaacggcagauguaccacagacgggguguugcugggaacuacccaacuaagcccggucaauauuugcacauuuaggggcgaugugacccauaucgcagguucccggaacuacacgaugaaucucgcuucacugaacuggaauaacuaugaccccacugaagagguaccugccccacuugggacacccgauuucguuggaaagauucagggcgugcugacccagacuacaaagggcgacgggaguacccgcggacacaaggcuacggucuacaccgguagcgccccuuuuacaccaaaauugggcucugugcaguucuccacugacaccgaaaaugauuuugagacacaucaaaacacuaaguucacccccgucggggugauccaggacggaggcacaacccaccgaaaugaaccgcagcaauggguucucccuucauacagcgguagagaugugcacaacguacaucuggcaccagccgucgcucccacuuuuccuggggagcaguuacuguucuuuaggaguacgaugcccggcuguucuggauauccaaauauggaccucgauugccuucugccucaggagugggugcagcacuucuaccaagaagcggcacccgcccaguccgacguugcuuugcuacgguuugugaacccagauacaggccguguccuguucgaguguaaacuccauaagagcggguaugugaccguagcccacacuggacagcacgaccuggugaucccgccuaaugguuacuuucgcuucgauucguggguuaaccaguucuauacccuugcacccaugggcaacgggacaggaagaaggcgggcccuguga

SEQ ID NO: 17771 - RNA, 1623 nt, Artificial Sequence; identical to SEQ ID NO: 17655
  derived and/or modified sequence opt3 from capsid_protein_VP1__Norovirus__AGE89589

SEQ ID NO: 17772 - RNA, 1623 nt, Artificial Sequence; identical to SEQ ID NO: 17655
  derived and/or modified sequence opt3 from capsid_protein_VP1__Norovirus__AGE89592

SEQ ID NO: 17773 - RNA, 1623 nt, Artificial Sequence; identical to SEQ ID NO: 17702
  derived and/or modified sequence opt3 from capsid_protein_VP1__Norovirus__AGE89595

SEQ ID NO: 17774 - RNA, 1623 nt, Artificial Sequence
  derived and/or modified sequence opt3 from capsid_protein_VP1__Norovirus__AGE89598
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggugcucccgagcuacagugguagagauguucagaacgugcaccuggccccugcaguagcuccaacuuuucccggggagcaguuacuguucuuuaggucuacgaugccuggcuguuccggauaucccaauauggaccucgauugccuucugccacaggaguggguccaacauuucuaccaggaagcggccccugcacagagcgacguggcuuugcuacgguuuguuaaccccgauacaggccgugugcuguucgaguguaaacuccacaagucgggguaugucaccguggcccauacuggacagcacgaccugguaauuccaccgaaugguuacuuucgcuucgauucuugggugaaccaauucuauacccuugcaccuaugggcaacgggacaggaagaaggcgggcccuguga

SEQ ID NO: 17775 - RNA, 1623 nt, Artificial Sequence; identical to SEQ ID NO: 17655
  derived and/or modified sequence opt3 from capsid_protein_VP1__Norovirus__AGE89601

SEQ ID NO: 17776 - RNA, 1623 nt, Artificial Sequence; identical to SEQ ID NO: 17655
  derived and/or modified sequence opt3 from capsid_protein_VP1__Norovirus__AGE89604

SEQ ID NO: 17777 - RNA, 1623 nt, Artificial Sequence; identical to SEQ ID NO: 17655
  derived and/or modified sequence opt3 from capsid_protein_VP1__Norovirus__AGE89607

SEQ ID NO: 17778 - RNA, 1623 nt, Artificial Sequence; identical to SEQ ID NO: 17655
  derived and/or modified sequence opt3 from capsid_protein_VP1__Norovirus__AGE89610

SEQ ID NO: 17779 - RNA, 1623 nt, Artificial Sequence; identical to SEQ ID NO: 17688
  derived and/or modified sequence opt3 from capsid_protein_VP1__Norovirus__AGE89613

SEQ ID NO: 17780 - RNA, 1623 nt, Artificial Sequence
  derived and/or modified sequence opt3 from capsid_protein_VP1__Norovirus__AGE89616
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccaacgcguucguugugcagccacagaaugguagauguacuaccgauggcgucuugcuggggacaacucaacuaucaccggugaacauaugcaccuuuaggggagacguaacacauauucccggcagucggaauuacaccaugaaccucgccagccagaauuggaacucuuaugauccuacggaggaaaucccagcaccccuggguacuccugacuucguugggaagauucagggagugcuuacacagaccacucgcacaaauggcuccacccgaggccacaaggcuacggucuacaccgggucagccgacuuuagcccaaagcugggaagagugcaauucgcuacagauacugacaacgauuuugagaccaaucagaacacaaaauucacucccgucggugugauccaggacggcaguaccacaccgaggaaugaaccucaacaguggguuuugccaucuuacuccgggcgggaugugcauaacguacaccucgcccccgcagucgccccuaccuuucccggagagcagcuguuauucuuucguagcacuaugccaggcuguucggguuauccuaauauggaccuggauugccuccuuccccaggaaugggugcaauacuucuaucaggaggcugcgccagcacagucugacguugcccuguugcgcuuugugaacccggauacggggagaguccuauucgaguguaagcugcacaaauccggcuacgugacaguagcucauaccggacagcacgaccucgugaucccucccaacggcuauuuuagguucgauucauggguuaaucaauucuacacucuggccccaauggggaacggaaccggucggcgacgcgcacuuuga

SEQ ID NO: 17781 - RNA, 1623 nt, Artificial Sequence; identical to SEQ ID NO: 17702
  derived and/or modified sequence opt3 from capsid_protein_VP1__Norovirus__AGE89622

SEQ ID NO: 17782 - RNA, 1623 nt, Artificial Sequence
  derived and/or modified sequence opt3 from capsid_protein_VP1__Norovirus__AGE89625
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaucaaccagaauaccaaauucacacccgucggugugauccaggacggcucuacuaccccgaggaacgaaccucaacaguggguuuugccauccuacagcgggcggaauauucauaacgugcaccucgcccccgcaguagccccuacauuucccggagagcagcuguuauucuuucguucgaccaugccaggcuguucugguuauccuaauauggaucuggacugccuccuuccccaggaauggguccaauacuucuaucaggaggcugcgccagcacaguccgauguggcccuguugcgcuuuguuaacccggacacugggagagugcuauucgaguguaagcugcacaaaucaggcuacgucacgguggcucauacaggacagcacgaucucguaauaccucccaacggcuauuuuagguucgacaguugggugaaucaauucuacacccuggccccaauggggaacggaacuggucggcgacgcgcacuuuga

SEQ ID NO: 17783 - RNA, 1623 nt, Artificial Sequence
  derived and/or modified sequence opt3 from capsid_protein_VP1__Norovirus__AGE89628
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugagaccaaucagaacacaaaauucacuccagucggugugauccaggauggcgggaccacacauaggaaugaaccccaacaguggguuuugccguccuacagcggacggaacauccacaaugugcaccucgccccugcaguagccccaaccuuucccggcgagcagcuguuauucuuucguucgacuaugccugguuguucuggguaucccaacauggaccuggauugccuccuuccacaggaauggguccaauacuucuaucaggaggcugcgccugcacaguccgacguggcccuguugcgcuuuguuaaucccgauacgggcagagugcuauucgaguguaagcugcauaaaucaggauacgucacaguggcucacaccggccagcaugaccucguaauuccaccgaacggguauuuuagguucgauaguugggugaaccaauucuacacucuggccccuaugggaaaugguaccggccggcgacgcgcacuuuga

SEQ ID NO: 17784 - RNA, 1623 nt, Artificial Sequence; identical to SEQ ID NO: 17655
  derived and/or modified sequence opt3 from capsid_protein_VP1__Norovirus__AGE89631

SEQ ID NO: 17785 - RNA, 1623 nt, Artificial Sequence; identical to SEQ ID NO: 17709
  derived and/or modified sequence opt3 from capsid_protein_VP1__Norovirus__AGE89634

SEQ ID NO: 17786 - RNA, 1623 nt, Artificial Sequence; identical to SEQ ID NO: 17655
  derived and/or modified sequence opt3 from capsid_protein_VP1__Norovirus__AGE89637

SEQ ID NO: 17787 - RNA, 1623 nt, Artificial Sequence; identical to SEQ ID NO: 17655
  derived and/or modified sequence opt3 from capsid_protein_VP1__Norovirus__AGE89640

SEQ ID NO: 17788 - RNA, 1623 nt, Artificial Sequence
  derived and/or modified sequence opt3 from capsid_protein_VP1__Norovirus__AGE89643
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaauggaugcucccgagcuacagugguagagaugugcacaacguucaucuggccccugcaguggcuccaacuuuucccggggagcaguuacuguucuuuaggucuacgaugccuggcuguuccggauaucccaauauggaccucgauugccuucugccacaggaguggguacagcacuucuaccaagaagcggccccugcacagagcgacgucgcuuugcuacgguuugugaaccccgauacaggccguguucuguucgaguguaaacuccauaagucgggguaugugaccgucgcccacacuggacagcacgaccuggugauuccaccgaaugguuacuuucgcuucgauucuuggguaaaccaguucuauacccuugcaccuaugggcaacgggacaggaagaaggcgggcccuguga

SEQ ID NO: 17789 - RNA, 1623 nt, Artificial Sequence; identical to SEQ ID NO: 17655
  derived and/or modified sequence opt3 from capsid_protein_VP1__Norovirus__AGE89646

SEQ ID NO: 17790 - RNA, 1623 nt, Artificial Sequence
  derived and/or modified sequence opt3 from capsid_protein_VP1__Norovirus__AGE89649
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacccaacaauuaaguugaucgcuaugcucuauacuccccugcgugccaacaacgcgggggaagauguguucaccgucucaugcagaguucugacaaggccgagcccugacuuugauuucauuuuucucgugcccccaaccguagagagucggacuaaaccuuucacagugcccaucuuaaccgucgaagagaugacuaauucccgcuuuccaauaccccuggagaaacuuuucacgggaccuucuggugccuucgugguucagccacagaacggcagauguaccacagacgggguguugcugggaacuacccaacuaagcccggucaauauuugcacauuuaggggcgaugugacccauaucgcagguucccggaacuacacgaugaaucucgcuucacugaacuggaauaacuaugaccccacugaagagauuccugccccacuugggacacccgauuucguaggaaagauccagggcguucugacccagacuacaaagggcgacgggaguacccgcggacacaaggcuacgguguacaccgguagcgccccuuuuacaccaaaauugggcucuguccaguucuccacugacaccgaaaaugauuuugagacacaucaaaacacuaaguucacccccgugggggucauccaggacggaggcacaacccaccgaaaugaaccgcagcaaugggugcucccuucauacagcgguagagauguucacaacgugcaucuggcaccagccguagcucccacuuuuccuggggagcaguuacuguucuuuaggaguacgaugcccggcuguucuggauauccaaauauggaccucgauugccuucugccucaggaguggguccagcacuucuaccaagaagcggcacccgcccaguccgacguggcuuugcuacgguuuguuaacccagauacaggccgugugcuguucgaguguaaacuccauaagagcggguaugucaccguggcccacacuggacagcacgaccugguaauuccgccuaaugguuacuuucgcuucgauucgugggugaaccaguucuauacccuugcacccaugggcaacgggacaggaagaaggcgggcccuguga

SEQ ID NO: 17791 - RNA, 1623 nt, Artificial Sequence
  derived and/or modified sequence opt3 from capsid_protein_VP1__Norovirus__AGE89652
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucgugcuagcgggaaacgcauuuacugccggcaaaauuaucuucgcugccguaccuccaaauuuuccgacggagggccucucucccucgcagguuaccauguucccucauaugauuguggacguccgccaacuggagccagugcuuaucccccugccugaugugcgaaacaauuuuuaucacuacaaccagucaaaugacccaacaauaaaguugaucgcaaugcucuauacuccccugcgugcuaacaacgccggggaugacgucuucaccguuagcugcagagugcugacaaggccgaguccugauuuugacuucauuuuucucguacccccaaccguggaaucccggacuaaaccuuucucuguccccaucuuaacaguggaggaaaugaccaauagccgcuuuccaauuccccuggagaaacuuuucacgggaccuuccucagcguucguugugcagccacagaacgguagauguacuaccgauggcgucuugcuggggacaacucaacuaaguccggugaauaucugcaccuuuaggggagacguaacacauauaaccggcagccacaacuacacgaugaaucucgccacucagaacuggaacucuuaugaucccacagaggaaauuccugcaccacuggguacccccgacuucguugggaagauccagggagugcuuacucagacaacccgggcugacggcuccacgcgcggccauaaggccaccgucuacacagggucagcugauuuugccccuaagcugggacgagugcaauucgcaacugacaccaauaaugauuugggugccaaccagaauacaaaauuuacuccagucggcgugauucaggacgggggaaccgcucacagaaacgagccccaacaguggguucucccgagcuacaguggcaggaacucucacaaugugcaucuggcgccugcaguagccccaacauuccccggugaacaguuacuguuuuuccgguccaccaugccuggguguagcggcuaucccaauauggaucucgacugccuucugccacaggaguggguccaauacuuuuaucaggaagcugccccugcacagucggauguggccuugcuacguuucguuaaccccgacacuggacgcgugcuguuugaguguaagcuccacaaaucuggcuacgucacgguggcucauacagggcagcacgaucugguaaucccaccgaacggauauuucagauuugacuccugggugaaucaauucuacacccuugccccuauggguaacggcacugggaggcggcgagcacuguga

SEQ ID NO: 17792 - RNA, 1623 nt, Artificial Sequence; identical to SEQ ID NO: 17655
  derived and/or modified sequence opt3 from capsid_protein_VP1__Norovirus__AGE89655

SEQ ID NO: 17793 - RNA, 1623 nt, Artificial Sequence; identical to SEQ ID NO: 17655
  derived and/or modified sequence opt3 from capsid_protein_VP1__Norovirus__AGE89658

SEQ ID NO: 17794 - RNA, 1623 nt, Artificial Sequence; identical to SEQ ID NO: 17655
  derived and/or modified sequence opt3 from capsid_protein_VP1__Norovirus__AGE89661

SEQ ID NO: 17795 - RNA, 1623 nt, Artificial Sequence
  derived and/or modified sequence opt3 from capsid_protein_VP1__Norovirus__AGE89664
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaagaugacuuugagacacaucaaaauacuaaguucaccccagugggggucauccaggauggaggcacaacccaccgaaacgaaccccagcaaugggugcucccgagcuacagugguagagacguucacaaugugcaucuggccccugcaguagcuccaacuuuucccggggagcaguuacuguucuuuaggucuacgaugccuggcuguuccggauaucccaacauggaucucgacugccuucugccacaggaguggguccagcacuucuaccaagaagcggccccugcacagagcgauguggcuuugcuacgguuuguuaaucccgacacaggccgugugcuguucgaguguaaacuccauaagucgggguaugucaccguggcccacacuggacagcacgaucugguaauuccaccgaacgguuacuuucgcuucgacucuugggugaaucaguucuauacccuugcaccuaugggcaacgggacaggaagaaggcgggcccuguga

SEQ ID NO: 17796 - RNA, 1623 nt, Artificial Sequence; identical to SEQ ID NO: 17655
  derived and/or modified sequence opt3 from capsid_protein_VP1__Norovirus__AGE89667

SEQ ID NO: 17797 - RNA, 1623 nt, Artificial Sequence; identical to SEQ ID NO: 17655
  derived and/or modified sequence opt3 from capsid_protein_VP1__Norovirus__AGE89673

SEQ ID NO: 17798 - RNA, 1623 nt, Artificial Sequence
  derived and/or modified sequence opt3 from capsid_protein_VP1__Norovirus__AGE99603
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcagaugauucuagcaggaaacgccuuuacagcuggcaaaaucauuuucgccgcagucccuccaaauuuuccgacugagggccucucucccucacaggugacgauguucccucauaucauaguagacguucgccaacuggagccagugcuuaucccccugccugauguccgaaacaauuuuuaucacuacaaccagucgaaugacccaaccauuaaguugaucgcuaugcucuauacaccccugcgugccaacaacgcgggggaugacguguucacugugagcugcagaguccugaccaggccgaguccugauuuugacuucauuuuucucguucccccaacaguggaaucccggaccaaaccuuucacuguacccguguuaacagucgaggaaaugaccaauucucgcuuuccaaucccccuggagaaacuuuucacgggaccuagcuccgccuucgugguucagccacagaacgguagauguacuaccgauggcguguugcuggggacaacucaacuaucaccggucaauauaugcaccuuuaggggagacgugacacauauugcaggcagucggaacuacaccaugaaucucgcuagccugaacuggaauaacuaugaucccacggaggaaaucccugccccacuugguacucccgacuucguagggaagauucagggaguucugacacagaccacuaagggcgacggcucuacacgcgggcacaaggcuaccguguacacgggauccgccgauuuuaccccuaaauuggguucaguccaguucggcacagacacugauaaugacuuugagacccaucaaaacacacgauucacuccagugggggucauccaggauggagcaaccacacacagaaaugaaccccagcaaugggugcucccgagcuacaguggcaggaacguucacaaugugcaucuggccccugcuguagcgccaaacuuucccggugagcaguuacuguucuuucggucuaccaugccuggguguuccggcuaucccaauauggaccucgauugccuucugccacaggaauggguccagcacuucuaccaagaggcagccccugcucagagcgacguggccuugcuacguuuuguuaaccccgauacuggacgcgugcuguucgaguguaagcuccauaaaucgggcuaugucacgguggcacacacagggcagcacgaccugguaaucccaccgaacggauacuuuagauucgauucuugggugaaucaguucuauacccuugccccuauggguaacggcacugggaggcggcgagcucuguga

SEQ ID NO: 17799 - RNA, 1623 nt, Artificial Sequence
  derived and/or modified sequence opt3 from capsid_protein_VP1__Norovirus__AGI17592
augaugauggccagcaacgacgcugcacccuccaaugauggcgccaccgggcuggugccugagaucaaccacgaaacacucccacuugagccggucgcgggagcugccauugcagcccccguuacuggucagaauaacauaaucgacccuuggauuagaacgaauuucgugcaagcuccaaacggcgaauuuaccguaucucccaggaacucaccuggggagauccuguugaauuuagaacugggaccagaucuaaaucccuaccucgcacaucugagucggauguauaacggcuacgccggugggguggagguccaggugcuucuggcuggaaaugccuucacagcgggcaagauuuuguuugcagccguuccuccaaacuucccgguggaguuucucagccccgcucagaucacuaugcugccucaccugauagucgacgugcgcacccucgaaccaaucaugauucccuuaccugauguacgaaauacauucuuucauuauaacaaucagccagccaaccguaugagacugguugcaaugcuuuacacccccuugagguccaacggcucuggggacgauguguucacugucucgugccgggugcugacacgcccgaccccugacuuugaguucacguaucuagugcccccaucagucgaaagcaagacuaagccuuuuagucuccccauccugaccauuuccgagcuuacaaauucuagauucccagcucccaucgauagccuguacacugcccaaaacaauaacuugaauguucagugucagaacggaaggugcacccucgacggugagcugcagggcacaacccaauuacugccuuccgggauaugugcguuucggggaaaacucacggccgaugugcaccagucacaugacgaucgcuggcacaugcagcuuacuaaucugaacggcacaccauucgacccgaccgaagacguacccgcaccuuuggguacuccagauuucacagggcuacuguuuggaguggcuagucagcgaaaugucgugagcaaccccaauaccacgagagcccacgaggcuguuauuucuaccacauccucacaauucgugccuaagcucggcagcaucaacuuuggcaguacuucugacgauuuccagcugcagcaaccaaccaaauuuacacccgucgggauuaagguggaauccggacaugacuucgaucagugggcccuuccgagguauagcggucaccugacuuugaauaugaaccucgcaccuccaguagcccccaauuuuccuggcgagcagcuguuauucuuucggucgaacguucccugcgcugggggagugucugacggcgucaucgauugucugcuaccacaggaauggauccaauacuucuaccaggaguccgcgccuucacagagugacguggcacucauucguuaugucaaccccgauaccggucgcacacuguuugaggccaaacuucauagaaccggguacauaacuguggcucacagcggcgacuauccauugguugugccguccaauggauacuucagguuugauucuuggguaaaccaguucuauagccuggccccuaugggcacggggaauggacggcgacgcguccaauga

SEQ ID NO: 17800 - RNA, 1650 nt, Artificial Sequence
  derived and/or modified sequence opt3 from capsid_protein_VP1__Norovirus__AGI17594
augaagauggccagcaacgacgcugcacccuccaaugauggcgccgcggggcuggugccugagaucaacucugaagcuauggcccucgagccagucgcaggagccgcuauugcagccccgcuuaccggucagcaaaauauaaucgaccccuggauuaugaacaauuucguucaggcuccuggcggggaauuuacaaucucaccaagaaacggacccggcgaggugcuguugaauuuagaacuggguccugagauuaacccauaccuagcccaccucgcgaggauguauaauggguacgcaggaggcuucgagguacaggugguccuggccggcaacgcuuuuacugccgggaaaaucauauucgcagcuauucccccuaauuuuccaauugauaaccuuagugccgcccaggugacgaugugcccgcauguuaucguggacguccggcaacuggaacccgugaauuugccuaugccagauguacgcaacagcuucuuucacuauaaucagggaaccgacucccgacuccgucugauugcgaugcuguacacaccccucagagcaaacaacucuggugaugacguuuucacugugucguguagggucuuaacccggccuucaccagauuuuagcuucaauuuucuggugcccccgacaguggagaguaagaccaaaccuuucacucuucccaucuugacaauauccgaaaugucuaacagccgcuuuccagucccuauugacucccugcauaccucacccacggauaauaucguugugcagugccagaacggcagaguaacucuagacggggagcucaugggaaccacacaacugcuuccaagucagauuugugcuuucaggggcgugcugacucagcggaccagccgcgccucugaucaggcugacacagccgucacgccccgagcauucgaccacagauggcauauccaauuggauaaucucaacgguacccacuaugacccuuccgaggauaucccagggccgcugggaauccccgacuuuaggggccggguguacggcguugccucacagcguaauagcgaugggaguacucgcgcucacgaagcgaagauagacacaaccucuuccagauucacuccuaaauuaggaagccuggagaucucgacagaaucugaugacuuugaugagaacaagccaaccagguucacgcccguggguauuggcgucgacaaugaacgggaguuucagcaauggucccucccugauuauucagggcaguucacccauaacaugcaccuugcaccagccguggcucccaauuuuccgggagagcagcuguuguucuuucgaagucaucuaccuagcuccggcgguuggguagacgggacacuggacugccuccugccacaggaauggauccaacacuucuaccaggagucugcccccagccagacucagguugcacuugugcgcuacgucaacccugauaccggcagagugcuguuugaagccaaguugcacaaaucaggauucaugacaauagcuaggaguggcgacucccccauuacugucccaccuaauggguauuuucgguucgagagcugggugaaccccuucuacacccucgccccaaugggaacagguaauggccgcagaaggauccaauga

SEQ ID NO: 17801 - RNA, 1623 nt, Artificial Sequence
  derived and/or modified sequence opt3 from capsid_protein_VP1__Norovirus__AGK36311
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcgcgucauucuagcaggaaacgccuuuacagcuggcaaaaucauuuucgccgcagugccuccaaauuuuccgacugagggccucucucccucgcagguaacgauguucccucauaucauaguugacgugcgacagcuggagccaguccuuaucccccugccugaugugcguaacaauuuuuaucacuacaaccaaaccaaugacucaacaauuaaguugaucgcuaugcucuauacuccacugagagccaacaacgcgggggaagauguguucaccgucagcugcaggguucugacacggcccaguccggacuuugauuucauuuuucucgugccucccaccguagagucccgcacuaaaccauucacagugccuaucuuaaccgucgaagagaugacuaauucuagauuucccauaccacuggagaaacuuuucacgggacccagcuccgccuucgugguucagccucagaacgguagguguaccacagacggcguguugcuggggacuacccagcuaucaccagucaauauuugcacauuucggggagaugugacccauaucgcaggcagucgcaacuacacgaugaaucucgcuagccugaacuggaauaacuaugacccgacugaagagauucccgccccucuugguacaccagauuucguagggaagauccaaggaguucugacccagacuacaaagggcgacggcucuacccgagggcacaaggcuacgguguacaccggauccgcccccuuuacaccuaaauuggguucaguccaguucagcacugacaccgaaaaugauuuugagauccaucagaacacaaaguucacuccagugggcgucauucaagacgggggaaccacacacagaaaugaaccccagcagugggugcucccgaguuacucuggcagggauguucacaacgugcaucuggccccugcaguagcuccaaccuuucccggugagcaauuacuguucuuucgguccacuaugccuggguguagcggcuaucccaauauggaccucgauugccuucugccacaggaguggguccagcacuucuaccaggaagcggccccugcacaaucggacguggcuuugcuacguuuuguuaaccccgauacgggacgcgugcuguucgaguguaaacuccauaagucuggcuaugucacaguggcccacaccgggcagcacgaccugguaauaccaccgaauggauacuuuagauucgauuccugggugaaccaguucuauacucuugcaccuauggguaacggcaccgggaggcggcgagcccuguga

SEQ ID NO: 17802 - RNA, 1623 nt, Artificial Sequence; identical to SEQ ID NO: 17702
  derived and/or modified sequence opt3 from capsid_protein_VP1__Norovirus__AGK36314

SEQ ID NO: 17803 - RNA, 1593 nt, Artificial Sequence
  derived and/or modified sequence opt3 from capsid_protein_VP1__Norovirus__AGM33208
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccgauacguuuguaccucaccugggcucgauucaggccaacgguaucgggucuggcaauuauguuggagugcucuccuggaucucaccacccagucauccuagcggcucccaagucgaccuuuggaagauuccaaacuacgggucuagcauaaccgaggcgacacaccuggcccccucaguguauccgccuggauucggugaagucuugguguuuuucaugaguaaaaugccaggccccggggcauacaaucuaccuugucugcucccccaggaguauaucucccaccuggcuagcgaacaggccccaacuguuggagaggcugcccuucugcauuacguggauccugacaccggccgcaacuugggugaguuuaaggcauaccccgauggguuccucacaugcguaccaaauggcgccucuucaggaccgcagcaacugccuauuaacggcgucuuuguguucguuaguugggugagccgauuuuaucaguuaaagcccgucgggacugcuuccucugcgagaggaaggcugggucuacggcguuga

SEQ ID NO: 17804 - RNA, 1593 nt, Artificial Sequence
  derived and/or modified sequence opt3 from capsid_protein_VP1__Norovirus__AGM33214
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgaugugaacacaacccccgacacguuuguaccucaccugggcucgauucaggccaaugguaucgggucuggcaacuauguuggagugcucuccuggaucucaccacccagucauccuagcggcucccaagucgaucuuuggaagauuccaaauuacgggucuagcauaaccgaggcgacacaccuggcccccucaguguauccgccuggauucggugaagucuugguguuuuucaugaguaaaaugccaggccccggggcauacaaccuaccuugucugcucccccaggaguauaucucccaccuggcuagcgaacaggccccaacuguuggagaggcugcccuucugcauuacguggacccugauaccggccgcaauuugggugaguuuaaggcauaccccgacggguuccucacaugcguaccaaacggcgccucuucaggaccgcagcaacugccuauuaauggcgucuuuguguucguuaguugggugagccgauuuuaucaguuaaagcccgucgggacugcuuccucugcgagaggaaggcugggucuacggcguuga

SEQ ID NO: 17805 - RNA, 1593 nt, Artificial Sequence; identical to SEQ ID NO: 17803
  derived and/or modified sequence opt3 from capsid_protein_VP1__Norovirus__AGM33217

SEQ ID NO: 17806 - RNA, 1593 nt, Artificial Sequence
  derived and/or modified sequence opt3 from capsid_protein_VP1__Norovirus__AGM33220
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccgauacguuuguaccucaccugggcucgauucaggccaacgguguugggucuggcaauuaugugggaguccucuccuggaucucaccacccagucauccuagcggcucccaaguggaccuuuggaagaucccaaacuacgggucuagcauuaccgaggcgacacaccuggcccccucagucuauccgccuggauucggugaaguguugguguuuuucaugaguaaaaugccaggccccggggcauacaaucuaccuugucugcucccccaggaguauauaucccaccuggcuagcgaacaggccccaacuguuggagaggcugcccuucugcauuacguagauccugacaccggccgcaacuugggugaguuuaaggcauaccccgauggguuccucacaugcgucccaaauggcgccucuucaggaccgcagcaacugccuaucaacggcguguuuguuuucgugaguugggucagccgauuuuaucaguuaaagcccguggggacugcuuccucugcgagaggaaggcugggucuacggcguuga

SEQ ID NO: 17807 - RNA, 1593 nt, Artificial Sequence
  derived and/or modified sequence opt3 from capsid_protein_VP1__Norovirus__AGM33226
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccgauauuuuuguaccucaccugggcucgauccaggccaacgguaucgggucuggcaauuauguuggagugcucuccuggauuucaccacccagucauccuagcggcucccaagucgaccuuuggaagauaccaaacuacgggucuagcaucacggaggcgacccaccuggcccccucaguguauccgccuggauucggugaagucuugguguuuuucaugaguaaaaugccaggccccggggcauacaaucuaccuugucugcucccccaggaguauauuucccaccuggcuagcgaacaggccccaacaguuggagaggcugcccuucugcauuacguggauccugacacuggccgcaacuugggugaguuuaaggcauaccccgauggguuccugaccugcguaccaaauggcgccucuucaggaccgcagcaacucccuaucaacggcgucuuuguguucguuaguugggugagccgauuuuaucaguuaaagcccgucgggacagcuuccucugcgagaggaaggcugggucuacggcguuga

SEQ ID NO: 17808 - RNA, 1593 nt, Artificial Sequence
  derived and/or modified sequence opt3 from capsid_protein_VP1__Norovirus__AGM33229
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccguaacguuuguuccucaccugggcucgauucaggccaacgguaucgggucuggcaauuaugugggaguccucuccuggaucucaccacccagucauccuagcggcucccaaguggaucuuuggaagauuccaaacuacgggucuagcauaaccgaggcgacacaccuggcccccucagucuauccgccuggauucggugaaguguugguguuuuucaugaguaaaaugccaggccccggggcauacaaucuaccuugucugcucccccaggaguauaucucccaccuggcuagcgaacaggccccaacuguuggagaggcugcccuucugcauuacguagacccugauaccggccgcaacuugggugaguuuaaggcauaccccgacggguuccucacaugcgucccaaauggcgccucuucaggaccgcagcaacugccuauuaacggcguguuuguuuucgugaguugggucagccgauuuuaucaguuaaagcccguggggacugcuuccucugcgagaggaaggcugggucuacggcguuga

SEQ ID NO: 17809 - RNA, 1593 nt, Artificial Sequence
  derived and/or modified sequence opt3 from capsid_protein_VP1__Norovirus__AGM33232
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcucuaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccgauacguuuguaccucaccugggcucgauucaggccaacgguaucgggucuggcaauuauguuggagugcucuccuggaucucaccacccagucgcccuagcggcucccaagucgaccuuuggaagauuccaaacuacgggucuagcauaaccgaggcgacacaucuggcccccucaguguauccgccuggauucggugaagucuugguguuuuucaugaguaaaaugccaggccccggggcauacaaucuaccuugucugcucccccaggaguauaucucccaccuggcuagcgaacaggccccaacuguuggagaggcugcccuucugcacuacguggauccugacaccggccgaaacuugggugaguuuaaggcauaccccgauggguuccucacaugcguaccaaauggcgccucuucaggaccgcagcaacugccuauuaacggcgucuuuguguucguuaguugggugagcagauuuuaucaguuaaagcccgucgggacugcuuccucugcgaggggacggcugggucuacgucgcuga

SEQ ID NO: 17810 - RNA, 1593 nt, Artificial Sequence; identical to SEQ ID NO: 17809
  derived and/or modified sequence opt3 from capsid_protein_VP1__Norovirus__AGM33235

SEQ ID NO: 17811 - RNA, 1593 nt, Artificial Sequence
  derived and/or modified sequence opt3 from capsid_protein_VP1__Norovirus__AGM33238
augaugauggccagcaaggacgcuaccuccucuguggauggcgcaucaggggccggacagcugguccccgagguuaacgcgagugacccucucgcuauggauccaguggccgguagcuccacagcaguagccacuacgggccaagugaauccgaucgaccccuggauuauaaacaauuucguccaggcuccucagggggaauuuaccaucucuccaaacaauacacccggagaugugcuuuucgaccugucguugggcccucacuuaaacccauuucugcuacaucucucacagauguacaaugguuggguugggaacaugagagugaggauuaugcuggcaggaaaugccuucacugcuggcaaaaucauugucagcugcauacccccuggcuuugggagucacaaccuuaccaucgcccaagcgacacuguucccacaugugaucgcagauguacggaccuuggacccgauugagguuccccucgaagaugugcgcaauguccuguuucacaacaaugaccgaaaccagcagacuaugcgucugguguguaugcucuauacaccuuuaagaaccggagguggcacgggggauuccuucguggucgccggaaggguuaugacuugcccaucucccgacuuuaauuuccuguuucuugugccuccaaccguagagcagaagacacggcccuucacuuugccgaaccugccucuaagcucccucucaaacagucgcgcuccccugccaaucagcucuaugggcauuuccccugauaaugugcaaucaguccaguuucagaacgguagauguacccuugacgggaggcuggugggaacaacccccguuagcuugagucauguggccaaaauccggggcacgucuaauggcacugucauaaaccucacagaacuggacgggaccccauuccaccccuucgagggaccugcaccaauugguuuuccggauuuaggcgggugcgacuggcacaucaauaugacucaguucggacauuccagccaaacacaguacgauguggacaccacgcccgauaccuuuguaccucaccugggcucgauucaggcuaacgguaucgggucuggcaauuauguuggagugcucuccuggaucucaccacccagucauccuagcggcucccaagucgaccuuuggaagauuccaaacuacgggucuagcauaacagaggccacucaccuggcgcccucaguguauccgccuggauucggugaagucuugguguuuuucaugaguaaaaugccaggccccggggccuacaaucuaccuugucugcucccccaggaguauaucucccaccuggcaagcgaacaggcuccaaccguuggagaggccgcccuucugcauuacguggauccugacacaggccgcaacuugggugaguuuaaggcuuaccccgauggguuccucacuugcguaccaaauggcgcaucuucaggaccgcagcaacugccuauuaacggcgucuuuguguucguuaguugggugagccgauuuuaucaguuaaagcccgucgggaccgccuccucugcuagaggaaggcugggucuacggcguuga

SEQ ID NO: 17812 - RNA, 1593 nt, Artificial Sequence; identical to SEQ ID NO: 17803
  derived and/or modified sequence opt3 from capsid_protein_VP1__Norovirus__AGM33241

SEQ ID NO: 17813 - RNA, 1593 nt, Artificial Sequence; identical to SEQ ID NO: 17804
  derived and/or modified sequence opt3 from capsid_protein_VP1__Norovirus__AGM33244

SEQ ID NO: 17814 - RNA, 1626 nt, Artificial Sequence
  derived and/or modified sequence opt3 from capsid_protein_VP1__Norovirus__AGO59890
augagaaugagcgacggcgccgcucccaaggcaaacggguccgaggccucuggacaggaucuggugccugcggcugucgaacaagccguuccaauccagccgguggccggugcagcucucgcagcccccgcugccggccagauuaaucagauagacccuuggaucuuccaaaacuuuguacagugcccacuuggggaguucucaauuagucccaggaauaccccuggagaaauccuguuugauuuggcguuaggcccaggucugaaccccuaccuagcacaccucagcgccauguauacagggugggugggaaauauggagguccagcuggugcuugcuggcaacgccuucacugcaggcaaaguuguggucgcucuggugccuccauacuuuccgaagggguccuugacgaccgcccagauuacauguuucccccauguaaugugcgacguucggacucucgaaccuauccaacugccacugcucgaugugcgccgagucuuauggcacgcgacccaggaccaggaggagucuaugcgucugguguguaugcuuuauacacccuugagaaccaauucgccuggagaugaaucauuuguggucagcgguaggcugcuaaguaaaccagccgcagacuucaacuuuguuuaccucacucccccgauagagcggacaaucuaucgcaugguggaucugccuguaauucagcccagacuuugcacccaugcuagguggccagccccuguguacggccuguuggucgaccccucccucccaucuaauccccaauggcagaacgggcgggugcacguugauggaacgcuguuaggcacuaccccuaucagcgguuccugggugucauguuucgcugccgaagcagccuauaaguuucagagugggauuggagaggucgcuacauucacucugaucgagcaagacggcagcgcguacgugccaggcgaucgcgcagccccgcucggguaccccgacuuuucuggacagcuugaaauagagguacagaccgaaacaaccaaaacgggugacaagcugaagguuacuacauucgagaugauuuugggcccuaccacuaaugcugaucaggccccauaucaagggcgaguguucgcauccgucacagccgcugccucacuagaccugguggauggaagagucagggcagugccccggagcaucuacggcuuucaggacaccauuccugaauauaacgauggucuccugguuccacuugcgcccccgaucgggccuuuccugccaggcgagguguugcuccguuuucgcacguacaugagacagaucgacaccgcugaugccgcagccgaggcuauugacugcgcccugccccaggaguucguaaguugguuugcaucuaaugcuuucacaguccaauccgaagccuuacugcuaagguaucggaacacucucaccggacagcugcuuuuugaauguaaauuguacaaugagggcuauauagcgcugagcuacucggggucuggaccucucacauuccccacugaugguaucuuugaagugguuuccugggugccacgacuguaccagcuugccucagucggcagucuggcuaccgggcgcauguugaagcaguga

SEQ ID NO: 17815 - RNA, 1620 nt, Artificial Sequence
  derived and/or modified sequence opt3 from capsid_protein_VP1__Norovirus__AGT17782
augaagauggccagcaacgacgcuacccccuccgaugggucuucagcaaaucuggugccugaggucaacaaugaaguuauggcccucgagccaguggcgggggcugccaucgcagccccgguagcuggacagcaaaacgugauugaccccuggauaagaaauaacuucguccaggcaccugguggcgaauuuacagugaguccaaggaaugcccccggggagauccuuuggagcgcuucccugggaccugauuugaacccauacuuaucucaccugucgcggauguauaauggcuacgccgguucauucgaaguucaggugauucuagcggggaacgcauuuacugccggaaaaaucauuuucgcugccgugcccccuaauuuucgcacggagggccucagcccaagucagaucaccauguucccgcauauaaucacagacguccgacaacuggagcccguacuuauuccucugccagauauccguaacaauuuuuaucacuacaaccaguccaaugaccccacuauuaaguugaucgcaaugcucuauaccccucugagagcuaacaacgccggcgaugacguuuucacagugucuugcaggguccugacccggccaagccccgauuuugacuucauauuucucgugccgccuacuguggaaucccgcacaaaacccuucucagucccaguuuuaaccguggaggaaaugacgaauaguagauuuccuauuccccuggagaaacuuuucacugggccaagcucugcguucguagugcagccccagaacggaagguguaccacagauggugucuugcugggcacuacccaacuauccccugugaauaucugcacauuucggggcgacguuacccgcauuggaaacucacgagaguacagaaugaaucucgccagccugaacuggaauaacuaugauccaacggaagagaucccggcaccccuuggcacuccugacuucgcugguaagauccagggggugcugacacagaccacuaggcaugacggaaguacacggggccacaaggccaccgucuacacgggcucugcuggguuuaccccaaaguugggauccgugcaguucagcacagauacugacaaugaucucgaagccaaccaaaauacccguuuuacacccguagguguuauucaggacggcaacgcacaucagggggagccucaacagugggugcugccaaauuacgccggacgcgauggccacaacguccacuuagcucccgcgguggcaccgacuuucccuggugaacagcugcucuuuuucagaucgaccaugccaggguguucuggcuaucccaauaugaaccuugacugccuguugccucaggaguggguccaacauuuuuaccaggaguccgcccccgcucagucagauguggcccuacugagguucguuaacccagacacaggacgggugcucuuugaauguaaacugcacaagaguggcuauguaaccgucgcacauacugggccucacgaucuugugauacccccaaauggauacuuccgauuugacagcuggguuaaccaguucuauacgcuggccccgauggguaauggcgcugggcgcagaagggccuuguga

SEQ ID NO: 17816 - RNA, 1593 nt, Artificial Sequence; identical to SEQ ID NO: 17803
  derived and/or modified sequence opt3 from capsid_protein_VP1__Norovirus__AGT17785

SEQ ID NO: 17817 - RNA, 1623 nt, Artificial Sequence
  derived and/or modified sequence opt3 from capsid_protein_VP1__Norovirus__AGT17788
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucucugugccuaucuuaacugucgaggaaaugacaaacagccgcuuucccauaccacuggagaaacuuuucaccggacccuccucaacguucgugguucagccucagaaugguagauguacuaccgauggcguguugcuggggacaacucaacuaaguccagucaacauuugcaccuuuaggggagacgugacacauaucaccggcagccggaauuacacgaugaaccucgccucucagaauuggaacuccuaugauccgacugaggaaauucccgcaccucuggguacaccagacuucguagggaagauccagggaguucuuacccagacuacacgcaccgacggcucaacgcgaggccacaaggcuaccguguacacagggagcgccgauuuuagucccaagcugggaagaguccaauucgcuacugacaccgauaaugacuuugaugccaaccagaauacaaaauucacuccugugggugucauccaggacggcgggaccacacauaggaacgagccacaacaguggguguugcccucuuacuccggacggaauacccacaacguucaccucgcaccggccguggcuccuacuuuuccaggcgaacagcuguuauucuuucguagcacgaugcccgguuguucgggguauccuaauauggaucuggacugccuccuuccccaggaguggguacaacauuucuaccaggaagcggcaccagcccagucugaugucgcucuguugcgcuuugugaacccugacacaggcagaguucuauucgaguguaagcugcacaaauccggauaugugaccgucgcccauacuggccagcacgaucucgugauucccccaaacggguacuuuagguucgacucauggguaaaucaauucuauacccuggcaccgaugggaaacgguacaggccggcgacgcgccguguga

SEQ ID NO: 17818 - RNA, 1593 nt, Artificial Sequence; identical to SEQ ID NO: 17803
  derived and/or modified sequence opt3 from capsid_protein_VP1__Norovirus__AGT17792

SEQ ID NO: 17819 - RNA, 1623 nt, Artificial Sequence
  derived and/or modified sequence opt3 from capsid_protein_VP1__Norovirus__AGT17795
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucaucaaucagaacaccaaauucacaccaguggguguuauccaggauggcuccacuacccccaggaaugagccgcaacaguggguguugccuagcuacucggggcggaacacacauaauguacaccucgccccagcagucgcccccaccuuuccuggagaacagcuguuauucuuucguucuacuaugcccggcuguuccgguuauccaaacauggaccuggauugccuccuuccucaggagugggugcaauacuucuaucaggaagcugcgcccgcacagucagacguugcccuguugcgcuuugugaauccagauacggggagaguccuauucgaguguaagcugcacaaaaguggcuacgugacaguagcucauaccggacagcacgaccucgugauuccgccuaacggcuauuuuagguucgauagcuggguuaaccaauucuacacucuggcccccauggggaauggaaccggucggcgacgcgcacuuuga

SEQ ID NO: 17820 - RNA, 1617 nt, Artificial Sequence
  derived and/or modified sequence opt3 from capsid_protein_VP1__Norovirus__AGT17798
augaagauggccagcuccgacgcuaaccccucugauggcucaaccgcaaaucuggugccugaggccaacaaugaagucauggcgcucgagccaguugugggggcugccaucgcagccccgguagcuggacagcaaaacgugaucgaccccuggauaagaaauaacuucguccaggcaccugguggcgaauuuacagugaguccaaggaaugcccccggggagguucuuuggagcgcuccucugggaccagauuugaaccccuacuuaucccaccuggcccggauguauaauggcuacgcggguggguucgaagugcaggucauccuagcaggaaacgccuuugcugccggcaaaauuaucuucgcagcugugccuccaaauuuuucuacugagggccucucgccgucacagguaacgauguucccccaucugauuguugacgugcgccaacuugagccugucaugaucccacugcccgauauacgaaacaauuuuuaucacuacaaccagagcaaugacccuaccaucaaguugauugccaugcucuauacaccacugcgugcgaacaacgugggggaugacguguucacugucaguugcagaguucugaccaggcccuccccggauuuugacuucaucuuucucgugccucccacaguagaaucuaaaaccaauccauucagcgugccuauuuuaacuaucgaggaaaugacaaacucccgguuucccauaccacuggagaaacuuuucaccggacccucaagugccuuggucgugcagccucagaauggucgcuguacgacugauggcguucugcuagggaccacacaacucagcccagugaacauuugcacuuucagaggagacgucacccauacaaccaagacgcacacuuaccagaugaaucuggcagcucagaacuggaacucuuaugauccgacagaggaaacccccgccccucuuggcacuccagacuuuguggguaagauccaggggguacugacacaaaccacgaagggaaauggcuccaccagggcucauaaagccacaguuuacacuggcaccguggaguucacacccaaguuggggcggauucagcucuuuacugacaccgauaaugaccuggaagcaaaccagaauacaaaauucaccccugucggagugauccaagauggugaccaccagaacgagccacagcagugggucuuacccucauacagcggccgcaauaaccacaaugugcaucuggccccggcuguugcgccuacuuuuccaggggaacaacuccuuuucuuucgaaguacgaugcccggauguucuggcuauccuaacaugaaccuggauugcuugcuaccccaggagugggugcaguacuucuaucaggaggcagccccagcucaauccgacguagcccugcucagauuugucaauccugauacagguagggugcuguucgaauguaaacuucacaagagcggguacguuaccguggcacauacuggccaccacgaccuggucauucccccaaacggauauuuucgguucgauucgugggugucuccguuuuacaccuuggccccuaugggcaaugggacaggacgucgcagagcucucuga

SEQ ID NO: 17821 - RNA, 1593 nt, Artificial Sequence; identical to SEQ ID NO: 17803
  derived and/or modified sequence opt3 from capsid_protein_VP1__Norovirus__AGT17803

SEQ ID NO: 17822 - RNA, 1593 nt, Artificial Sequence; identical to SEQ ID NO: 17803
  derived and/or modified sequence opt3 from capsid_protein_VP1__Norovirus__AGT17806

SEQ ID NO: 17823 - RNA, 1593 nt, Artificial Sequence; identical to SEQ ID NO: 17803
  derived and/or modified sequence opt3 from capsid_protein_VP1__Norovirus__AGT17809

SEQ ID NO: 17824 - RNA, 1623 nt, Artificial Sequence
  derived and/or modified sequence opt3 from capsid_protein_VP1__Norovirus__AGT17813
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucucugugccuaucuuaacugucgaggaaaugacaaacagccgcuuucccauaccacuggagaaacuuuucaccggacccuccucaacguucgugguucagccucagaaugguagauguacuaccgauggcguguugcuggggacaacucaacuaaguccagucaacauuugcaccuuuaggggagacgugacacauaucgccggcagccggaauuacaccaugaaccucgcaucucagaauuggaacuccuaugauccgacggaggaaauucccgcuccucuggguacuccagacuucguagggaagauccagggaguucuuacacagaccacucgcacagacggcucaacccgaggccacaaggccacgguguacaccgggagcgcugauuuuagucccaagcugggaagaguccaauucgccacagacacugauaaugacuuugaugcaaaccagaauaccaaauucacaccugugggugucauccaggacggcgggacugcccauaggaacgagccacaacaguggguguugcccucuuacuccggacggaauacccacaacguucaccucgcuccggcgguggcaccuacauuuccaggcgaacagcuguuauucuuucguagcaccaugcccgguuguucgggguauccuaauauggaucuggacugccuccuuccccaggaguggguacaauacuucuaucaggaagccgcuccagcccagucugaugucgcacuguugcgcuuugugaacccugacacuggcagaguucuauucgaguguaagcugcauaaacccggauacgugacggucgcccacacaggccagcaugaucucgugauuccaccgaacggguauuuuagguucgacuccuggguaaaucaauucuacacccuggcuccuaugggaaacgguacuggccggcgacgcgcccuuuga

SEQ ID NO: 17825 - RNA, 1623 nt, Artificial Sequence
  derived and/or modified sequence opt3 from capsid_protein_VP1__Norovirus__AGT17816
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaguaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagagcaacgacaguaccauuaaguugaucgcuaugcucuauacaccacugcgugccaauaacgcgggggaugacguguucacugucuccugcagaguucugaccaggcccucuccggauuuugacuucauuuuucucgugccucccacaguagaaagccggaccaaaccauucacugugccuaucuuaacagucgaggaaaugaccaacucccgcuuucccauaccacuggagaaacuuuucacgggacccucaagugccuucgugguucagccucagaaugguagauguacuaccgauggcguguugcuggggacaacucaacuaagcccagucaacauuugcaccuuuaggggagacgugacacauaucgcaggcucucggaauuacaccaugaaccucgcuucccugaauuggucaaacuaugauccgacggaggaaauucccgccccucuugguacuccagacuucguagggaagauccagggaguucugacacagaccacuaagggcgacggcagcacacgcgggcacaaggcuaccguguacacgggaagugccgauuuuacccccaaauuggguucuguccaguucgcaacagacacugagaaugauuuugaaacccaucaaaacacacgauucacuccugugggcgucauccaggacgggggaaccacacacagaaaugagccacagcaaugggugcuccccuccuacagcggcaggaacguucacaaugugcaucuggccccggcuguagcgccuaacuuuccaggugaacaguuacuguucuuucggucgaccaugcccggguguucuggcuauccuaauauggaucucgacugccuucugccccaggaguggguccagcacuucuaccaagaggcagccccagcucaguccgauguggccuugcuacguuuuguuaacccugacacuggacgcgugcuguucgaauguaagcuccauaaaucaggcuaugucacgguggcacacacagggcagcacgaucugguaauucccccaaauggauacuuuagauucgacaguugggugaaccaguucuauacccuugccccgauggguaacggcacugggaggcggcgagcucuguga

SEQ ID NO: 17826 - RNA, 1623 nt, Artificial Sequence
  derived and/or modified sequence opt3 from capsid_protein_VP1__Norovirus__AGT17819
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauugccggcagccggaacuacaccaugaaucucgcaucucagaacuggaacuccuaugaucccacggaggaaaucccugcuccacuggguacucccgacuucguugggaagauucagggagugcuuacacagaccacucgcacagacggcucaacccgaggccacaaggccacggucuacaccgggagcgcugauuuuaguccuaagcugggaagagugcaauucgccacagacacugauaaugacuuugucaccaaucagaacacaaaauucacuccaguggguguuauccaggauggcgggaccacacccaggaaugagccgcaacaguggguguugccuucuuacuccggacggaacacccauaauguacaccucgcaccagccgucgcucccacuuuuccuggcgaacagcuguuauucuuucguagcacgaugcccgguuguucgggguauccaaacauggaccuggauugccuccuuccucaggagugggugcaauacuucuaucaggaagcggcacccgcccagucugacguugcucuguugcgcuuugugaauccagauacaggcagaguccuauucgaguguaagcugcacaaauccggauacgugaccguagcccauacuggccagcacgaccucgugaucccgccuaacggguauuuuagguucgauucauggguuaaccaauucuacacccuggcacccaugggaaaugguacaggccggcgacgcgcccuuuga

SEQ ID NO: 17827 - RNA, 1623 nt, Artificial Sequence
  derived and/or modified sequence opt3 from capsid_protein_VP1__Norovirus__AGT17823
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccacuucugauccccuugccugauguccgaaacaauuuuuaucacuacaaccagucaaaugacccaacaauuaagcucaucgcaaugcuguauacuccccugcgugcuaacaacgccggggaugacguguucaccgugagcugcagaguccucacaaggccgaguccugauuuugacuucaucuuuuuaguucccccaaccguggaaucccggacuaaaccuuucucuguacccauucugacaauagaggaaaugaccaauagccgcuuuccaauuccccuugagaaguuguucacgggaccuuccucagcguucgugguccagccacagaacgguagauguacuaccgauggcgugcugcuagggacaacucaacucaguccgguuaauaucugcaccuuuaggggagacgugacacauauuaccggcacgcacaacuacgccaugaaucuggcagcucagaacuggaauagcuaugaucccacugaggaaaucccugccccacuugguacacccgacuucgucgggaaaauccagggagugcugacccagacuacacgggcugacggcucuacccgcgcccauaaggcaacgguauacaccggcuccgccgaguuugcuccuaaguuggggcgaguucaauucgcgacagauacugacucagauuuugacaccaaccagaauacaaaauucacuccagugggagucauucaggaugguaacaccgcacaccaaaaugaaccccagcagugggugcucccgagcuacaguggcagaaacaaucacaacguccaucuggccccugcuguggccccaacauuucccggggagcaguuacuguucuuuaggucuaccaugccuggauguuccggcuaucccaauaugaaccucgacugccuucugccacaagaauggguucaguacuucuaucaggaggcagccccugcucagagcgauguggccuugcuacgguuuguaaaccccgacacuggucguguccuguucgaguguaagcuccacaaaucgggguacgugacgguugcacauacaggccaacacgaucuggugauaccaccgaauggauauuuucgcuucgacucuugggucuccccuuucuacacccuugcgcccaugggcaacgggacuggaagaaggcgggcucuguga

SEQ ID NO: 17828 - RNA, 1593 nt, Artificial Sequence; identical to SEQ ID NO: 17803
  derived and/or modified sequence opt3 from capsid_protein_VP1__Norovirus__AGT17826

SEQ ID NO: 17829 - RNA, 1620 nt, Artificial Sequence
  derived and/or modified sequence opt3 from capsid_protein_VP1__Norovirus__AGT17830
augaagauggccagcaacgacgcuacccccuccgaugggucuucagcaaaucuggugccugaggccaacaaugaagucauggcgcucgagccaguugcuggggccgcaaucgccgcuccgguggcaggacagcaaaacguaauugaccccuggauaagaaauaacuucgugcaggccccugguggcgaauuuacagucaguccaaggaaugcucccggggagauccuuuggagcgccucccugggaccugauuugaacccauacuuaucucaccugucgcggauguauaauggcuacgcggguucauucgaagugcagguuauucuagcagggaacgccuuuacugcuggaaaaaucauuuucgccgcagugcccccuaauuuucgcacggagggccucagcccaagucagaucaccauguucccgcauauaaucacagacguccgacaacuggagcccgugcuuauuccucugccagauauccguaacaauuuuuaucacuacaaccaguccaaugaccccacuauuaaguugaucgcuaugcucuauaccccucugagagccaacaacgcgggcgaugacguauucacaguuucuugcagggugcugacccggccaagccccgauuuugacuucauauuucucgucccgccuacuguggaaucccgcacaaaacccuucucagugccagucuuaaccguugaggaaaugacgaauaguagauuuccuauuccccuggagaaacuuuucacugggccaagcucugccuucgugguacagccccagaacggaagguguaccacagaugguguguugcugggcacuacccaacuauccccugucaauaucugcacauuucggggcgacgugacccgcauuggaaacucacgagaguacagaaugaaucucgcaagccugaacuggaauaacuaugauccaacggaagagaucccggcuccccuuggcacuccugacuucgccgguaagauccaggggguucugacacagaccacuaggcaugacggaaguacacggggccacaaggcuaccguguacacgggcucugccggguuuaccccaaaguugggauccguccaguucagcacagauacugacaaugaucucgaagcaaaccaaaauacccguuuuacacccguggguguaauucaggacggcaacgcccaucagggggagccucaacaguggguucugccaaauuacgcuggacgcgauggccacaacgugcacuuagcgcccgcagucgccccgacuuucccuggugaacagcugcucuuuuucagaucgaccaugccaggguguucuggcuaucccaauaugaaccuugacugccuguugccucaggagugggugcaacauuuuuaccaggaguccgcucccgcccagucagaugucgcacuacugagguucgugaacccagacacaggacggguucucuuugaauguaaacugcacaagaguggcuaugugaccguagcccauacugggccucacgaucuugucauacccccaaauggauacuuccgauuugacagcugggugaaccaguucuauacgcuggcuccgauggguaauggcgccgggcgcagaagggcauuguga

SEQ ID NO: 17830 - RNA, 1623 nt, Artificial Sequence
  derived and/or modified sequence opt3 from capsid_protein_VP1__Norovirus__AGT17833
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauugccggcucucggaacuacaccaugaaucucgcaucccagaacuggaacucauaugauccgacggaggaaauccccgcuccucuggguacuccagacuucguugggaagauucagggagugcuuacacagaccacucgcacagacggcagcacccgaggccacaaggccacggucuacaccgggagugcugauuuuucucccaagcugggaagagugcaauucgccacagacacugauaaugacuuugucaccaaucagaacacaaaauucacuccuguggguguuauccaggauggcuccaccacaccaaggaaugagccccaacaguggguguugccgagcuacucggggcggaacacccauaauguacaccucgccccugcagucgcuccaacuuuucccggagaacagcuguuauucuuucguucuacgaugccuggcuguuccgguuaucccaacauggaccuggauugccuccuuccacaggagugggugcaauacuucuaucaggaagcggccccugcacagucagacguugcucuguugcgcuuugugaaucccgauacagggagaguccuauucgaguguaagcugcacaaaaguggcuacgugaccguagcccauacuggacagcacgaccucgugaucccaccgaacggcuauuuuagguucgauagcuggguuaaccaauucuacacccuggcaccuauggggaauggaacaggucggcgacgcgcccuuuga

SEQ ID NO: 17831 - RNA, 1593 nt, Artificial Sequence; identical to SEQ ID NO: 17803
  derived and/or modified sequence opt3 from capsid_protein_VP1__Norovirus__AGT17836

SEQ ID NO: 17832 - RNA, 1620 nt, Artificial Sequence
  derived and/or modified sequence opt3 from capsid_protein_VP1__Norovirus__AGT17842
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccgggcagguaaccauguucccucauaucauaguugacgugcgccaacuggagccaguccuuaucccccugccugaugugcgaaacaauuuuuaucacuacaaccagucgaaugacccaacaauuaaguugguggcaaugcucuauacuccccugcgugcuaacaacgccggagaugacgucuucaccguuucaugcagagugcugacaaggccgagcccugauuuugacuucaucuuucucguacccccaaccauugaaaguaaaacuaaguccuucucugugccuaucuuaacaauagaggaaaugaccaauagccgguuucccauuccacuggagaaacuuuucacgggucccuccucaacuuuggucgugcagccucagaacggccgcuguaccacagaugggguucugcuaggaacuacccaacucaguccagugaauaucugcacauucagaggcgacgucacccagauuacgaacacucauagcuacgagaugaaucuggcggcccagaacuggaacucuuaugauccgacagaagagauccccgcaccucuugguaccccagacuuuguggggaagauccagggaguacugacucaaacaaccaaggaaaauggcuccacgagggcucacaaagccaccguuuacacaggcucaacuggguucacccccaaguugggacgggugcaguuugucacagacacugaucgcgaccucgagaccaaucaggauacaaaauucaccccugugggugucauucaagacggcgaugcucaucagaacgaaccacagcagugggugcugcccagcuacuuagggacuaauaaccacaauguucaccuggccccggcaguggccccuacguuuccaggagagcaacuccuuuucuuucgaaguacaaugcccggcuguucugguuauccuaacaugaaucuggacugcuugcuaccccaggaguggguacaguacuucuaucaggaagcugcgccagcacaauccgaugucgcccugcucagauuugugaacccugacaccgggaggguucuguucgaguguaaacuucauaagagcggcuacgugacugucgcucacaccggacggcaugaucuggugauacccccaaacggcuauuuucguuucgacucguggguaucuccguuuuacacauuggccccuauggggaauggaaccggucgcagaagggcacucuga

SEQ ID NO: 17833 - RNA, 1623 nt, Artificial Sequence
  derived and/or modified sequence opt3 from capsid_protein_VP1__Norovirus__AGU68328
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuugcugccggcaaaaucauuuucgcagcugugccuccaaauuuuccgacagagggccucucucccucgcagguaacuauguucccucauaucauaguugacgugcgccaacuggagccaguccuuaucccccugccugaugugcgaaacaauuuuuaucacuacaaccagucaaaugacagcacgauuaaguugaucgccaugcucuauaccccacugcgugcgaacaacgccggggaugacguguucacagucaguugcagaguucugacuaggcccuccccggauuuugacuucauuuuucucgugccucccaccguagaaucucggacaaaaccauucagcgugccugucuuaaccguggaggaaaugacuaauucccgcuuucccaucccacuggagaaacuuuucacaggacccucaagugcauucguugugcagccucagaacgguagauguaccacggauggcgucuugcuggggacuacccaacuaagcccagugaauauaugcacacucaggggagacguaacucauauuaccggcucucggaacuacacaaugaaucuggcuucccagaacuggaauaacuaugauccgaccgaggaaauccccgccccucuugguacgccagacuuuguugggaagauucagggaaugcugacucagacaacccgcacugacggcucaacacgaggcuacaaggcuaccguguacacggggagcgccgauuucgcacccaaguugggaagaguccaauuugagaccgacacagaucacgacuucgaagccaaucagaacacuaaauuuaccccugugggugucauccaggauggcaguacaacucauaggaaugagccacaacagugggugcuccccucuuauuccgggcggaacacccacaauguucaccuggcuccggcgguggcaccuacauucccaggagaacaguuacuguuuuuccguagcaccaugcccggcuguucggguuacccuaacauggaccucgauugccuucugccccaggaguggguacaauauuuuuaccaggaggccgcuccagcccagucugacgucgcauugcuacgcuucgugaauccugauacugggagaguucuguuugaauguaagcuccauaaauccggcuaugugacggucgcccacacaggacagcaugaccuggugauucccccaaacggcuacuucagguuugauucauggguaaaccaauucuauacccuugcuccgauggggaauggaacuggucggcgacgcgugguuuga

SEQ ID NO: 17834 - RNA, 1620 nt, Artificial Sequence
  derived and/or modified sequence opt3 from capsid_protein_VP1__Norovirus__AGX85889
augaagauggccagcuccgacgcuaaccccucugauggcucaaccgcaaaucuggugccugaggccaacaaugaagucauggcgcucgagccaguugugggggcugccaucgcagccccgguagcuggacagcaaaacgugauugaccccuggauaagaaauaacuucguccaggcaccugguggcgaauuuacagugaguccaaggaaugcccccggggagauccuuuggagcgcuccucugggaccagauuugaaccccuacuuaucccaccugucucggauguauaauggcuacgccgguggguucgaaguucaggugauucuagcgggaaacgcauuugccgcuggcaaaaucauuuucgccgcagucccuccaaauuuuccgacugagggccucucgcccucacaggugacgauguucccucaucugaucguagacguucgccaacuugagccagugaugauaccccugccugauauccgaaacaauuuuuaucacuacaaccagagcaaugacccaaccauuaaguugaucgcuaugcucuauacaccccugcgugccaacaacgucggggaugacguguucacugugaguugcagaguccugaccaggccguccccugauuuugacuucauuuuucucguucccccaacaguggaaucuaaaaccaauccuuucagcguacccaucuuaacuauagaggaaaugacaaacucccgguuuccaauuccccuggagaaacuuuucaccggaccuucaagugcguuggugguccagccacagaauggucgcuguacgacugauggcgugcugcuagggaccacacaacucagcccgguuaacaucugcacuuucagaggagacgugacccauacaaccaagacgcacacuuaccagaugaaucuggccgcacagaacuggaacucuuaugaucccacagaggaaauuccugcuccacuuggcacccccgacuuugucgguaagauccagggggugcugacucaaacaaccaagggaaauggcuccacgagggcccauaaagcuaccguauacacaggcucagccgaguucacuccuaaguuggggcggauccagcucuuuaccgacacagauaaugaccuggaagcaaaccagaauacuaaauucaccccaguuggagugauucaagauggugacacacaccagaacgagccccagcagugggucuuaccgagcuacaguggccgcaauaaccacaaugugcaucuggccccugcugucgcgccaaccuuucccggggaacaacuccuuuucuuucgaucuacuaugccuggauguuccggcuaucccaacaugaaccuggauugcuugcuaccacaggagugggugcaguacuucuaucaggaggcagccccugcucaaagcgacguugcccugcucagauuugugaaucccgauacggguaggguacuguucgaauguaaacuucacaagucgggguacgucacaguggcacauaccggccaccacgaccuguuuauaccaccgaacggauauuuccgguuugauucuuggguuuccccuuucuacacuuuggcccccaugggcaaugggaccggacgucgcagagcucucuga

SEQ ID NO: 17835 - RNA, 1620 nt, Artificial Sequence
  derived and/or modified sequence opt3 from capsid_protein_VP1__Norovirus__AGX85892
augaagauggccagcuccgacgcuaaccccucugauggcucaaccgcaaaucuggugccugaggccaacaaugaagucauggcgcucgagccaguugugggggcugccaucgcagccccgguagcuggacagcaaaacgugauugaccccuggauaagaaauaacuucguccaggcaccugguggcgaauuuacagugaguccaaggaaugcccccggggagguucuuuggagcgcuccucugggaccagauuugaaccccuacuuaucccaccuggcccggauguauaauggcuacgcggguggguucgaagugcaggucauccuagcaggaaacgccuuugcugccggcaaaauuaucuucgcagcugugccuccaaauuuuccgacugagggccucucucccucgcagguaacgauguucccucaucugauuguugacgugcgccaacuugagccagucaugaucccccugccugauauacgaaacaauuuuuaucacuacaaccagucaaaugacccaaccaucaaguugauugccaugcucuauacaccccugcgugcgaacaacgugggggaugacguguucacugucagcugcagaguucugaccaggccgaguccugauuuugacuucaucuuucucgugcccccaacaguagaauccaaaaccaauccuuucucugugcccauuuuaacuaucgaggaaaugacaaacagccgguuuccaauaccccuggagaaacuuuucaccggaccuuccucagccuuggucgugcagccacagaauggucgcuguacgacugauggcguucugcuagggaccacacaacucaguccggugaacauuugcacuuucagaggagacgucacccauacaaccaagacgcacacuuaccagaugaaucuggcagcucagaacuggaauagcuaugaucccacagaggaaaucccugccccacuuggcacccccgacuuuguggguaagauucaggggguacugacucaaacaaccaagggaaacggcucuacgagggcucauaaagccaccguuuacacaggcgggguggaguucacuccuaaguugggacggauccagcucuuuaccgacacagauaaugaccuggaagcaaaccagaauacuaaauucaccccagucggugugauccaagauggcgacacacaccagaacgagccccagcagugggucuuaccguccuacucagggcgcaauaaccacaaugugcaucuggccccugcuguugcgccaaccuuucccggagaacaacuccuuuucuuucgaagcacuaugccuggcuguagugguuaucccaacaugaaccuggauugcuugcuaccacaggagugggugcaguacuucuaucaggaggcagccccugcucaaucugacguagcccugcucagauuugucaaucccgauacggggagggugcuguucgaauguaaacuucacaaguccggcuacguuacaguggcacauaccggacaccacgaccuguuuauuccaccgaacggcuauuuccgguuugauagcugggucucgccuuucuacacuuuggcccccauggggaauggaaccggucgucgcagagcucucuga

SEQ ID NO: 17836 - RNA, 1620 nt, Artificial Sequence
  derived and/or modified sequence opt3 from capsid_protein_VP1__Norovirus__AGX85895
augaagauggccagcuccgacgcuaaccccucugauggcucaaccgcaaaucuggugccugaggccaacaaugaagucauggcgcucgagccaguugugggggcugccaucgcagccccgguagcuggacagcaaaacgugauugaccccuggauaagaaauaacuucguccaggcaccugguggcgaauuuacagugaguccaaggaaugcccccggggagguucuuuggagcgcuccucugggaccagauuugaaccccuacuuaucccaccuggcccggauguauaauggcuacgcggguggguucgaagugcaggucauccuagcaggaaacgccuuugcugccggcaaaauuaucuucgcagcugugccuccaaauuuuccgacugagggccucucucccucgcagguaacgauguucccucaucugauuaucgacguucgccaacuugagccagugaugauaccccugccugauguccgaaacaauuuuuaucacuacaaccagucaaaugacccaaccaucaaguugauugccaugcucuauacaccccugcgugcgaacaacgugggggaugacguguucacugucagcugcagaguucugaccaggccgaguccugauuuugacuucaucuuucucgugcccccaacaguagaauccaaaaccaauccuuucucugugcccauuuuaacuaucgaggaaaugacaaacagccgguuuccaauaccccuggagaaacuuuucaccggaccuuccucagccuuggucgugcagccacagaauggucgcuguacgacugauggcguucugcuagggaccacacaacucaguccggugaacauuugcacuuucagaggagacgucacccauaucacaaagacccacagcuaccagaugaaucuggcagcucagaacuggaacucuuaugaucccacggaggaaauuccugccccacuuggcacucccgacuuuguggguaagauccaggggguacugacacaaaccacuaagggaaauggcuccacaagggcucauaaagccaccguuuacacgggcucaaccgaguucacaccuaaguuggggcggauccagcucgugacugacaccgauaaugaccuggaaacaaaccagaauacuaaauuuaccccagucggagugauucaagauggugacacacaccagaacgagccccagcagugggucuuaccgagcuaccugggccgcaauaaccacaaugugcaucucgccccugcaguugcuccaaccuuccccggggaacaacuucuguuuuuccgaaguacuaugccuggauguucuggcuaucccaacaugaacuuggauugccuacugccacaggagugggugcaguacuuuuaucaggaggcggccccugcacaauccgacguagcucuccugagauucgucaaucccgauacggguagggugcuuuuugaauguaagcugcacaaaagcggguacguuacaguggcccauaccggccaccacgacuuguucauaccaccgaacggauauuuucgguucgauucgugggucucuccuuuuuacacucucgcacccaugggcaaugggaccggacgucgcagagcccuguga

SEQ ID NO: 17837 - RNA, 1623 nt, Artificial Sequence
  derived and/or modified sequence opt3 from capsid_protein_VP1__Norovirus__AGX85904
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaguaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagagcaacgacaguaccauuaaguugaucgcuaugcucuauacaccacugcgugccaauaacgcgggggaugacguguucacugucuccugcagaguucugaccaggcccucuccggauuuugacuucauuuuucucgugccucccacaguagaaagccggaccaaaccauucacugugccuaucuuaacagucgaggaaaugaccaacucccgcuuucccauaccacuggagaaacuuuucacgggacccucaagugccuucgugguucagccucagaaugguagauguacuaccgauggcguguugcuggggacaacucaacuaagcccagucaacauuugcaccuuuaggggagacgugacacauaucgcaggcucucggaauuacaccaugaaccucgcuucccugaauuggucaaacuaugauccgacggaggaaauucccgccccucuugguacuccagacuucguagggaagauccagggaguucugacacagaccacuaagggcgacggcagcacacgcgggcacaaggcuaccguguacacgggaagugccgauuuuacccccaaauuggguucuauccaguucgcaacagacacugagaaugauuuugaaacccaucaaaacacacgauucacuccugucggcgugauucaggacgggggaaccacacacagaaaugagccacagcaauggguccuccccuccuacagcggcaggaacgugcacaauguucaucuggccccggcuguggcgccuaacuuuccaggugaacaguuacuguucuuucggucgaccaugcccggguguucuggcuauccuaauauggaucucgacugccuucugccccaggaguggguacagcacuucuaccaagaggcagccccagcucaguccgaugucgccuugcuacguuuugugaacccugacacuggacgcguucuguucgaauguaagcuccauaaaucaggcuaugugacggucgcacacacagggcagcacgaucuggugauacccccaaauggauacuuuagauucgacaguuggguaaaccaguucuauacccuugccccgauggguaacggcacugggaggcggcgagcucuguga

SEQ ID NO: 17838 - RNA, 1617 nt, Artificial Sequence
  derived and/or modified sequence opt3 from capsid_protein_VP1__Norovirus__AGX85913
augaagauggccagcuccgacgcuaaccccucugauggcucaaccgcaaaucuggugccugaggccaacaaugaagucauggcgcucgagccaguugugggggcugccaucgcagccccgguagcuggacagcaaaacgugauugaccccuggauaagaaauaacuucguccaggcaccugguggcgaauuuacagugaguccaaggaaugcccccggggagguucuuuggagcgcuccucugggaccagauuugaaccccuacuuaucccaccuggcccggauguauaauggcuacgcggguggguucgaagugcaggucauccuagcaggaaacgccuuugcugccggcaaaauuaucuucgcagcugugccuccaaauuuuucuacugagggccucucgccgucacagguaacgauguucccccaucugauuguugacgugcgccaacuugagccugucaugaucccacugcccgauauacgaaacaauuuuuaucacuacaaccagagcaaugacccuaccaucaaguugauugccaugcucuauacaccacugcgugcgaacaacgugggggaugacguguucacugucaguugcagaguucugaccaggcccuccccggauuuugacuucaucuuucucgugccucccacaguagaaucuaaaaccaauccauucagcgugccuauuuuaacuaucgaggaaaugacaaacucccgguuucccauaccacuggagaaacuuuucaccggacccucaagugccuuggucgugcagccucagaauggucgcuguacgacugauggcguucugcuagggaccacacaacucagcccagugaacauuugcacuuucagaggagacgucacccauacaaccaagacgcacacuuaccagaugaaucuggcagcucagaacuggaacucuuaugauccgacagaggaaauccccgccccucuuggcaccccagacuuuguggguaagauucaggggguacugacucaaacaaccaaggagaauggauccacgagggcucauaaagccaccguuuacacaggcacuguggaguucacccccaaguugggccggauccagcucuuuacagacacugauaaugaccuggaagcaaaccagaauaccaaauucacaccugucggggugauccaagauggagaccaccagaacgaaccacagcagugggucuuacccucauacagcggucgcaauaaccacaaugugcaucuggccccggcuguugcgccuaccuuuccaggcgagcaacuccuuuucuuucgaaguacuaugcccggguguucuggauauccuaacaugaaccuggauugcuugcuaccccaggagugggugcaguacuucuaucaggaagcagccccagcucaauccgacguagcccugcucagauuugucaauccugauacgggcagggugcuguucgaguguaaacuucacaagagcgguuacguuacaguggcacauaccgggcaccacgaccuggucauucccccaaacggcuauuuucgguucgauucgugggugucuccguuuuacacuuuggccccuaugggaaauggcaccgggcgucgcagagcucucuga

SEQ ID NO: 17839 - RNA, 1623 nt, Artificial Sequence
  derived and/or modified sequence opt3 from capsid_protein_VP1__Norovirus__AGX85916
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucucugugccuaucuuaacugucgaggaaaugacaaacagccgcuuucccauaccacuggagaaacuuuucaccggacccuccucaacguucgugguucagccucagaaugguagauguacuaccgauggcguguugcuggggacaacucaacuaaguccagucaacauuugcaccuuuaggggagacgugacacauaucaccggcagccggaauuacacgaugaaccucgccucucagaauuggaacuccuaugauccgacugaggaaauucccgcaccucuggguacaccagacuucguagggaagauccagggaguucuuacccagacuacacgcaccgacggcucaacgcgaggccacaaggcuaccguguacacagggagcgccgauuuuagucccaagcugggaagaguccaauucgcuacugacaccgauaaugacuuugauacaaaccagaauacuaaauucaccccugugggugucauccaggacggcgggacaacccauaggaacgagccacaacaguggguguugcccucuuacuccggacggaauacucacaacguucaccucgccccggcaguggccccuacguuuccaggcgaacagcuguuauucuuucguagcacaaugcccgguucgucuggguauccuaauauggaucuggacugucuccuuccccaggaguggguacaauacuucuaucaggaagcugcgccagcacaguccgaugucgcccuguugcgcuuugugaacccugacaccggcagaguucuauucgagugcaagcugcauaaaucaggauacgugacugucgcucacaccggccagcaugaucucgugauucccccaaacggguauuuuagguucgacaguuggguaaaucaauucuacacacuggccccgaugggaaacgguaccggccggcgacgcgcaguguga

SEQ ID NO: 17840 - RNA, 1617 nt, Artificial Sequence; identical to SEQ ID NO: 17838
  derived and/or modified sequence opt3 from capsid_protein_VP1__Norovirus__AGX85931

SEQ ID NO: 17841 - RNA, 1617 nt, Artificial Sequence
  derived and/or modified sequence opt3 from capsid_protein_VP1__Norovirus__AGX85934
augaagauggccagcuccgacgcuaaccccucugauggcucaaccgcaaaucuggugccugaggccaacaaugaagucauggcgcucgagccaguugugggggcugccaucgcagccccgguagcuggacagcaaaacgugauugaccccuggauaagaaauaacuucguccaggcaccugguggcgaauuuacagugaguccaaggaaugcccccggggagguucuuuggagcgcuccucugggaccagauuugaaccccuacuuaucccaccuggcccggauguauaauggcuacgcggguggguucgaagugcaggucauccuagcaggaaacgccuuugcugccggcaaaauuaucuucgcagcugugccuccaaauuuuucuacugagggccucucgccgucacagguaacgauguucccccaucugauuguugacgugcgccaacuugagccugucaugaucccacugcccgauauacgaaacaauuuuuaucacuacaaccagagcaaugacccuaccaucaaguugauugccaugcucuauacaccacugcgugcgaacaacgugggggaugacguguucacugucaguugcagaguucugaccaggcccuccccggauuuugacuucaucuuucucgugccucccacaguagaaucuaaaaccaauccauucagcgugccuauuuuaacuaucgaggaaaugacaaacucccgguuucccauaccacuggagaaacuuuucaccggacccucaagugccuuggucgugcagccucagaauggucgcuguacgacugauggcguucugcuagggaccacacaacucagcccagugaacauuugcacuuucagaggagacgucacccauacaaccaagacgcacacuuaccagaugaaucuggcagcucagaacuggaacucuuaugauccgacagaggaaauccccgccccucuuggcaccccagacuuuguggguaagauucaggggguacugacucaaacaaccaagggaaauggcuccacgagggcucauaaagccaccguuuacacaggcacuguggaguucacccccaaguuggggcggauccagcucuuuacagacacugauaaugaccuggaagcaaaccagaauaccaaauucacaccugucggagugauccaagauggugaccaccagaacgagccacagcagugggucuuacccucauacagcggccgcaauaaccacaaugugcaucuggccccggcuguugcgccuaccuuuccaggggaacaacuccuuuucuuucgaaguacuaugcccggauguucuggcuauccuaacaugaaccuggauugcuugcuaccccaggagugggugcaguacuucuaucaggaggcagccccagcucaauccgacguagcccugcucagauuugucaauccugauacggguagggugcuguucgaauguaaacuucacaagagcggguacguuacaguggcacauaccggccaccacgaccuggucauucccccaaacggauauuuucgguucgauucgugggugucuccguuuuacacuuuggccccuaugggcaaugggaccggacgucgcagagcucucuga

SEQ ID NO: 17842 - RNA, 1644 nt, Artificial Sequence
  derived and/or modified sequence opt3 from capsid_protein_VP1__Norovirus__AHI59154
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaggaugucuuuacaguuucaugucgcguguuaacuagaccagcccccgacuucgaguuuaccuuccugguaccgccuacaguggaaagcaagaccaaacccuuuacucuuccaauuuugacacugggcgagcuaaguaacuccagguucccugcgcccaucgauaugcucuauaccgacccaaaugaagggauugucgugcaaccccagaacggacggugcacgcuggaugguacucuucagggcaccacacagcugguuccuacucaaaucugugccuuucgcgggaccuugauaggacagacaucucgaagcuccgacucaaccgauagugcaccaagaaggcgggaccacccgcuccaugugcagcugaagaauuuagauggcacgcaauacgaccccacugacgaggucccugcugugcugggugccauugauuucaaagggacaguauucggaguugcuagccagcgugacgugucuggccagcaggucggcgccacccgcgcacacgaagugcacaucaacacuacagauccaagauauacccccaagcucggguccauucuuaugcauucagagagcgacgauuuugucacgggacaaccugugagguucaccccaaucgguaugggcgacaaugauuggcaccagugggagcugcccgacuacagugggcauuugacacuaaacaugaaucuggccccggcuguugcgccugcauuuccaggagaacggauccucuucuuucgaucuauggugcccuccgccggcgguuacgggagcggccagauugauugccugaugccucaggaguggguacaacacuucuaucaggaagcugcccccucgcagucugcagucgcccuuauacgcuacgugaacccagacacuggaagaaauaucuuugaggcuaagcugcacagggaaggcuucauuaccguugccaacuccgggaauaacccuaucguggugcccccaaauggauauuuucgguucgaggcaugggucaaccaguuuuacacauugacuccgauggguaccggccaagggcgcagaaggaaucaguga

SEQ ID NO: 17843 - RNA, 1623 nt, Artificial Sequence
  derived and/or modified sequence opt3 from capsid_protein_VP1__Norovirus__AHI59157
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucuccgugcccgucuuaacaguggaggaaaugaccaacucucgcuuuccaaucccccuggagaaacuuuucacgggaccuagcuccgcguucguugugcagccacagaaugguagauguacuaccgauggcgucuugcuggggacaacucaacuaucaccggugaacauaugcaccuuuaggggagacguaacacauauuaccggcagucggaauuacacgaugaaccucgccagccagaauuggaacucuuaugaucccacugaggaaaucccugcaccacuggguacacccgacuucguugggaagauucagggagugcuuacccagacuacacgcaccgacggcuccacgcgaggccacaaggcuaccgucuacacagggucagccgauuuuagcccuaagcugggaagagugcaauucgcuacugacaccgauaaugacuuugagacaaaccagaauacuaaauucaccccagucggugugauccaggauggcgggacaacccauaggaacgaaccccaacaguggguuuugccgaguuacucuggacggaauacucacaacgugcaccucgccccugcaguagccccaacguuucccggcgagcagcuguuauucuuucguuccacaaugccugguuguagcggguaucccaauauggaccuggauugccuccuuccacaggaauggguccaauacuucuaucaggaggcugcgccugcacagucggacguggcccuguugcgcuuuguuaaccccgauaccggcagagugcuauucgaguguaagcugcauaaaucuggauacgucacuguggcucacaccggccagcaugaccucguaaucccaccgaacggguauuuuagguucgauuccugggugaaucaauucuacacacuggccccuaugggaaacgguaccggccggcgacgcgcacuuuga

SEQ ID NO: 17844 - RNA, 1629 nt, Artificial Sequence
  derived and/or modified sequence opt3 from capsid_protein_VP1__Norovirus__AHI59159
augaagauggccagcaacgacgcugcacccuccaccgauggcgccgcggggcuggugccugagucuaauucagaagucauggcucucgagccaguugccggagcagcccuugcugcaccggugacaggucagacuaacaucauugaccccuggauaagagccaauuucguacaagcuccuaacggcgaauuuacggugaguccaaggaaugcccccggggagguccuguugaacuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuuccccgugucuauagaucagauguacaccagcccaaacgaggucaucuccgugcagugucagaacgguagaugcacacuugacggcgaacugcaagggacuacccaguugcagguuucaggaauuugugccuuuaagggcgaggugacagcacaccuccaugauaaugaccaccuguauaacgucaccaucacgaauuuaaacgguagucccuucgacccuagcgaagaugugccagcuccgcuggggguacccgacuuccagggaaggguuuuuggcgugauuucucaacgggauaagcacaauuccccuggccauaacgagccagccaaucgcgggcacgacgcugucgugcccacuuacacagcccaguacaccccuaaacucggacagguccaaaucgguacuuggcagacagaugaccuuaccgugaaccagccaguuaaguucacgcccgugggccugaaugauaccgaacauuuuaaccaguggguagucccgcgauaugcaggggccuugaaucuaaacacaaaucuggcuccuucaguggcgccaguuuuccccggagagagacuccuguuuuucaggagcuacgugccucuuaaaggcgguuaugggaaccccgcaauagacugccuguugccacaagaguggguccagcacuuuuaccaggaagccgcuccuaguaugucugagguggcccucguacgguauauuaaucccgauacuggccgugcacuguucgaagccaaguuacaccgcgcuggauuuaugaccguguccagcaacacaucggccccaguugucgugccggcaaacggcuacuucagauuugacucuugggugaaucaguucuauucccuggcgccuauggggacuggaaacgguaggcggcgaguccaauga

SEQ ID NO: 17845 - RNA, 1623 nt, Artificial Sequence
  derived and/or modified sequence opt3 from capsid_protein_VP1__Norovirus__AHK24788
augagaaugagcgacggcgccgcucccaaggcaaacggguccgaggccucuggacaggaucuggugccuaccgcggucgaacaagcuguuccaauccagccgguggccggugcaucacucgccgcucccgcagccggccagauuaaucagauagacccuuggaucuuccaaaacuuuguacagugcccacuuggggaguucaguauuagccccaggaauacaccuggagaaauccuguuugauuuggcuuuaggcccaggucugaaccccuaccuagcccaccucuccgcgauguauacugggugggugggaaauauggagguccagcuggugcuugcaggcaacgccuucacggcuggcaaaguuguggucgcccuggugccuccauacuuuccgaaggggucuuugaccgcagcucagauuacauguuucccccauguaaugugcgacguucggacucucgaaccuauccaacugccacugcucgaugugcgccgagucuuauggcacgccacccaggaccaggaggagucgaugcgucugguguguaugcuuuauacacccuugagaaccaauucaccuggagaugagagcuuuguggucagugguaggcugcuauccaaaccagcggccgacuucaacuuuguuuaccucacucccccgauagaacggacaaucuaucgcaugguggaucugccuguacuucagcccagacugugcacccaugcaagguggccagcuccuguguacggcuugcucgucgaccccucucugccaagcaauccccaauggcagaacgggcgggugcacguugauggaacguuacugggcacuaccccuguguccgguucaugggucaguuguuucgccgcugaagccgcauaugaguuucagagcgggacaggagagguggccacuuucacccucauugaacaagacggcucugcuuacguaccaggcgaucgcgcggcaccgcuuggguaccccgacuuuuccggacagcuggagaucgaaguucagacagagaccacgaaggccggugacaaauugaaggugacuacauucgaaaugauucuaggcccuaccacuaaugucgaucaggcuccauaucaagggcgaguguacgccucacugacagcagccgcuagccucgaccuggucgauggaagagugagggccguuccccggaguaucuauggcuuccaggaccagauaccugaguacaacgauggucuucuggugccauuggcacccccgguagggccuuuucucccaggcgagcuguuacugcguuuccgcaccuauaugagacagauugacucugcggaugcugccgcagaagccaucgacugcgcucuaccccaagaguuuauuuccugguucgccagcaaugcauuuacgguccagucggaagcucuccugcuuagguaccggaacaccuugacaggacagcuccuguucgaguguaagcuguauucugaaggcuacaucgcccuuuccuacucagggaguggaccucugacuuuucccaccgaugguuucuuugaggugguuagcugggugccacgauuguaucagcucgcguccgucggcucucuggccacagggcgcacuuuaaaauga

SEQ ID NO: 17846 - RNA, 1623 nt, Artificial Sequence
  derived and/or modified sequence opt3 from capsid_protein_VP1__Norovirus__AHX22018
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccggugccuucgucgugcagccacagaacggcagauguacgacugaugggguauugcugggaaccacacaacuaucaccgguuaauauuugcacuuuuaggggcgacgugacccauaucacagguagucggaacuacaccaugaaucucgcaagccagaacuggaauaacuaugaucccacggaggaaauaccugcuccacuggggacucccgacuucgucggaaagauucagggcaugcuuacacagaccacucgcacagacggcucuacccgagggcacaaggccacgguguacaccggauccgcugauuuugccccuaagcuggguagaguccaauucgagacagacacugaucaugacuuugaagcaaaucagaacaccaaauucacaccagugggcguuauccaggaugggucaacuacccacaggaaugagccccaacaguggguguugccgagcuacaguggacggaacacacacaauguacaucucgccccugcugucgcgccaaccuuucccggcgaacagcuguuauucuuucguucuacuaugccugguuguuccggguaucccaacauggaccuggauugccuccuuccacaggagugggugcaauacuucuaucaggaggcagccccugcucagagcgacguugcccuguugcgcuuugugaaucccgauacgggcagaguccuauucgaauguaagcugcacaaaucgggauacgugacaguagcacauaccggccagcacgaccucgugauuccaccgaacggguauuuuagguucgauucuuggguuaaccaauucuacacucuggccccuaugggaaaugguaccggccggcgacgcgucguguga

SEQ ID NO: 17847 - RNA, 1623 nt, Artificial Sequence
  derived and/or modified sequence opt3 from capsid_protein_VP1__Norovirus__AHX22021
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucacaacugacaccgauaaugacuuugucacaaaucagaacacuaaauucaccccaguggguguuauccaggauggcuccacaacccccaggaaugagccgcaacaguggguguugccuagcuacucggggcggaacacucauaauguacaccucgcuccagccgucgcacccacguuuccuggagaacagcuguuauucuuucguucuacaaugcccggcuguuccgguuauccaaacauggaccuggauugccuccuuccucaggagugggugcaauacuucuaucaggaagccgcucccgcgcagucagacguugcacuguugcgcuuugugaauccagauaccgggagaguccuauucgaguguaagcugcacaaaaguggcuacgugacuguagcccauaccggacagcacgaccucgugaucccgccuaacggcuauuuuagguucgauagcuggguuaaccaauucuacacacuggcucccauggggaauggaaccggucggcgacgcgcccuuuga

SEQ ID NO: 17848 - RNA, 1623 nt, Artificial Sequence
  derived and/or modified sequence opt3 from capsid_protein_VP1__Norovirus__AHX22025
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcagacuauucuagcgggaaacgcauuuacggccggcaaaaucauuuucgcugccgucccuccaaauuuuccgaccgagggccucucucccucacaggugacaauguucccucauaucauaguagacguucgccaacuggagccagugcuuaucccccugccugauguccgaaacaauuuuuaucacuacaaccagacuaaugacccaaccauuaaguugaucgcaaugcucuauacaccccugcgugcuaacaacgccggggaugacguguucaccgugucgugcagaguccugacuaggccgagcccugauuuugacuucauuuuucucguucccccaacaguggaaagucggaccaaaccuuucuccguacccguguuaacggucgaggaaaugacuaauucucgcuuuccaaucccccuggagaaacuuuucaccggaccuagcuccgcguucgugguucagccacagaacgguagauguacaacugauggcguguugcuggggaccacacaacuaucaccggucaauauaugcaccuuuaggggagacgugacgcauauuaguggcagccggaacuacacuaugaaucucgccucucagaacuggaacuccuaugaucccacagaggaaaucccugcaccacuggguacccccgacuucguagggaagauucagggaguucuuacucagacaacccgcacggacggcucaacccgaggccacaaggcuacaguguacacugggagcgccgauuuuaguccuaagcugggaagaguccaauucgcuaccgacacagauaaugacuuugagacuaaucagaacaccaaauucacaccagugggugucauccaggauggcgggaccacucauaggaaugaaccccaacaguggguguugccgucuuacuccggacggaacacgcacaauguucaccucgccccugcaguggccccaacauuucccggcgagcagcuguuauucuuucguagcaccaugccugguuguucgggguaucccaacauggaccuggauugccuccuuccacaggaauggguacaauacuucuaucaggaggcugcgccugcacagucugacgucgcccuguugcgcuuugugaaucccgauacuggcagaguucuauucgaguguaagcugcauaaauccggauacgugaccgucgcucacacaggccagcaugaccucgugaucccaccgaacggguauuuuagguucgauucauggguaaaccaauucuacacccuggccccuaugggaaaugguacuggccggcgacgcgcacuuuga

SEQ ID NO: 17849 - RNA, 1623 nt, Artificial Sequence
  derived and/or modified sequence opt3 from capsid_protein_VP1__Norovirus__AHX22028
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggaggcagccccugcucagagcgacguggcccuguugcgcuuugucaaucccgauacgggcagagugcuauucgaauguaagcugcacaaaucgggauacguaacaguggcacauaccggccagcacgaccucguuauuccaccgaacggguauuuuagguucgauucuugggucaaccaauucuacacucuggccccuaugggaaaugguaccggccggcgacgcgugguguga

SEQ ID NO: 17850 - RNA, 1623 nt, Artificial Sequence
  derived and/or modified sequence opt3 from capsid_protein_VP1__Norovirus__AHX22032
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcagacuauucuagcgggaaacgcauuuacggccggcaaaaucauuuucgcugccgucccuccaaauuuuccgaccgagggccucucucccucacaggugacaauguucccucauaucauaguagacguucgccaacuggagccagugcuuaucccccugccugauguccgaaacaauuuuuaucacuacaaccagacuaaugacccaaccauuaaguugaucgcaaugcucuauacaccccugcgugcuaacaacgccggggaugacguguucaccgugucgugcagaguccugacuaggccgagcccugauuuugacuucauuuuucucguucccccaacaguggaaagucggaccaaaccuuucuccguacccguguuaacggucgaggaaaugacuaauucucgcuuuccaaucccccuggagaaacuuuucaccggaccuagcuccgcguucgugguucagccacagaacgguagauguacaacugauggcguguugcuggggaccacacaacuaucaccggucaauauaugcaccuuuaggggagacgugacgcauauuaguggcagccggaacuacacuaugaaucucgccucucagaacuggaacuccuaugaucccacagaggaaaucccugcaccacuggguacccccgacuucguagggaagauucagggaguucuuacucagacaacccgcacggacggcucaacccgaggccacaaggcuacaguguacacugggagcgccgauuuuaguccuaagcugggaagaguccaauucgcuaccgacacagauaaugacuuugagacuaaucagaacaccaaauucacaccagugggugucauccaggauggcgggaccacucaucaaaaugaaccccagcaguggguguugccgucuuacuccggaagggacacgcacaacguucaccucgccccugcaguggccccaacauuucccggcgagcagcuguuauucuuucggagcaccaugccugguuguucgggguaucccaauauggaucuggacugccuccuuccacaagaauggguacaguacuucuaucaggaggcugcgccugcacagucugaugucgcccuguugcguuuugugaaccccgacacuggccgcguucuauucgaguguaagcugcauaaauccggauacgugaccgucgcucacacaggccaacaugaucucgugaucccaccgaauggguauuuuagauucgacucauggguaaaccaguucuacacccuggccccuaugggaaacgguacuggcaggcggcgagcacuuuga

SEQ ID NO: 17851 - RNA, 1623 nt, Artificial Sequence
  derived and/or modified sequence opt3 from capsid_protein_VP1__Norovirus__AHX22038
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucugaacuggaauaacuaugaucccacggaggaaauaccugcuccacuugguacucccgacuucgucgggaagauucagggaaugcugacacagaccacucgcacagacggcuccacccgaggccacaaggccacgguguacaccgggucagcugauuuugccccuaaguugggaagaguccaguucgagacagacacugaucaugacuuugaagcaaaucaaaacaccaaauucacaccaguggguguuauccaggauggcagcacuacccacaggaaugagccccagcaaugggugcucccgaguuacucugggcggaacacacacaauguacaucuggccccugcugucgcgccaaccuuucccggagaacaguuacuguucuuucguuccacuaugccuggcuguagcgguuaucccaacauggaccucgauugccuucugccacaggagugggugcaguacuucuaucaagaggcagccccugcucagucggacguugccuugcuacgcuuugugaaucccgauacggggagaguccuguucgaauguaagcuccacaaaucuggcuacgugacaguagcacauaccggacagcacgaccuggugauuccaccgaacggcuauuuuagguucgauuccuggguuaaccaguucuacacucuugccccuauggggaauggaaccggucggcgacgcgucguguga

SEQ ID NO: 17852 - RNA, 1623 nt, Artificial Sequence
  derived and/or modified sequence opt3 from capsid_protein_VP1__Norovirus__AHX22041
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuugccccuaagcugggacgagugcaauucgcaacagacacugaucacgacuuugaggccaaucagaacaccaaauucacaccaguuggugugauccaggauggcgggacuacccacagaaaugaaccccaacaguggguauugccgagcuacaguggaaggaacacacauaauguccaccucgcuccugcgguggcaccaaccuuucccggcgagcagcuguuauucuuucggucuacuaugccugguuguuccggguaucccaacauggaccuggauugccuccuuccacaggaauggguucaauacuucuaucaggaggccgcuccugcccagagcgacguggcacuguugcguuuugucaaucccgauacgggccgcgugcuauucgaguguaagcugcauaaaucgggauacguaacaguggcccacaccggccagcacgaccucguuauuccaccgaacggguauuuuagauucgauucuugggucaaccaauucuacacucuggcuccuaugggaaaugguaccggcaggcggcgagugguguga

SEQ ID NO: 17853 - RNA, 1623 nt, Artificial Sequence
  derived and/or modified sequence opt3 from capsid_protein_VP1__Norovirus__AHX22047
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaagcgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauucccggcucucggaauuacaccaugaaccucgccucccagaauuggaacucauaugauccuacggaggaaaucccagcaccccuggguacuccugacuucguugggaagauucagggagugcuuacacagaccacucgcacaaauggcagcacccgaggccacaaggcuacggucuacaccgggagugccgacuuuucuccaaagcugggaagagugcaauucgcuacagauacugacaacgauuuugagaccaaucagaacacaaaauucacucccgucggugugauccaggacggcuccaccacaccgaggaaugaaccucaacaguggguuuugccaagcuacucggggcggaacauccauaaugugcaccucgcccccgcaguagccccuaccuuucccggagagcagcuguuauucuuucguucuacuaugccaggcuguuccgguuauccuaacauggaucuggacugccuccuuccccaggaauggguccaauacuucuaucaggaggcugcgccagcacagucagauguggcccuguugcgcuuuguuaauccggacacggggagagugcuauucgaguguaagcugcacaaaaguggcuacgucacaguggcucauaccggacagcacgaucucguaauuccucccaacggcuauuuuagguucgacagcugggugaaccaauucuacacucuggccccaauggggaauggaaccggucggcgacgcgcacuuuga

SEQ ID NO: 17854 - RNA, 1623 nt, Artificial Sequence
  derived and/or modified sequence opt3 from capsid_protein_VP1__Norovirus__AHX22050
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucaccaaucagaacacaaaauucacuccaguggguguuauccaggauggcuccaccacacccaggaaugagccgcaacaguggguguugccuagcuacucggggcggaacacccauaauguacaccucgccccagcagucgcccccacuuuuccuggagaacagcuguuauucuuucguucuacgaugcccggcuguuccgguuauccaaacauggaccuggauugccuccuuccucaggagugggugcaauacuucuaucaggaagcugcgcccgcacagucagacguugcccuguugcgcuuugugaauccagauacagggagaguccuauucgaguguaagcugcacaaaaguggcuacgugaccguagcucauacuggacagcacgaccucgugaucccgccuaacggcuauuuuagguucgauagcuggguuaaccaauucuacacccuggcccccauggggaauggaacaggucggcgacgcgcacuuuga

SEQ ID NO: 17855 - RNA, 1623 nt, Artificial Sequence
  derived and/or modified sequence opt3 from capsid_protein_VP1__Norovirus__AHX22054
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaauucauaucucuggcucccggaacuacacaaugaaucucgccucacagaacuggaauagcuaugauccgaccgaggaaauucccgcaccucuggguacgccagacuucguugggaagauccagggagugcuuacucagacaacccgcacugacggcaguacacgaggccacaaggcuaccgucuacacggggucugccgauuuuucccccaagcugggaagagugcaauucgcuaccgacacagauaacgacuuugucacuaaucagaacaccaaauucacaccuguggguguuauccaggauggcagcacuaccccaaggaaugagccccaacaguggguguugccgucguacucugggcggaacacacauaauguacaccucgccccugcagucgccccaaccuuucccggagaacagcuguuauucuuucguuccacuaugccuggcuguucagguuaucccaacauggaccuggauugccuccuuccacaggagugggugcaauacuucuaucaggaagcugcgccugcacagagugacguugcccuguugcgcuuugugaaucccgauacggggagaguccuauucgaguguaagcugcacaaaagcggcuacgugacaguagcucauaccggacagcacgaccucgugauuccaccgaacggcuauuuuagguucgauuccuggguuaaccaauucuacacucuggccccuauggggaauggaaccggucggcgacgcgcacuuuga

SEQ ID NO: 17856 - RNA, 1647 nt, Artificial Sequence
  derived and/or modified sequence opt3 from capsid_protein_VP1__Norovirus__AIA96988
augaagauggccagcaacgacgcugcacccuccaaugauggcgccgcggggcuggugccugagaucucuaacgaagcuauggcccucgacccagucgcaggagccgcuauugcagccccgcuuaccggucagcaaaauauaaucgaucccuggauuaugaacaauuucguucaggcuccuggcggggaguuuacagugucaccaagaaacagucccggagaaauccuguugaauuuagagcugggcccugaaauuaacccauaccuagcccaccucgcgaggauguauaaugguuacgcagggggauucgagguacaggugguccuggccggcaacgcuuuuacugccggcaaagugaucuucgcagcuauacccccuaauuuuccaacggacaaccuuagcgccgcgcagaucaccaugugcccgcauguuauuguggauguccggcaacuggagcccaucaauuugccuaugccagacgugcgcaacaauuucuuucacuauaaccagggguccgauucucgacuccgucugauugccaugcuguacacaccccucagagcaaacaauucgggagacgauguauucacuguuucauguaggguguuaacccggccuagcccagacuuuaguuucaacuuucuggugcccccgacagucgaauccaagaccaaaccuuucacucuucccaucuugacaauaucugagaugagcaauucccgcuuuccagugccuauugauucacugcauaccagucccacggacaacaucgucguucagugccagaaugguagagugacucuagauggcgaacucauggggaccacacaacugcuuccaagccagauuugugcuuucaggggaguacugacucggucuaccucccgcgccucagaccacgcugacacagccacgccccgauuguucaacuauuacuggcauauccagcucgauaaucugaacggcaccccuuaugacccagcagaggauaucccggcccccuuagguacuccugacuuuagagggaagguguucggagucgcuagccagaggaauccagauaguacaacccgggcgcacgaggcaaaaguggacacuacaucuggccguuuuacccccaagcugggcucccucgaaaugagcacggagucggaugacuucgaucaaaaccagccuacccgcuuuacaccaguugggauuggaguggacaaugaagccgauuuccagcaauggacucuucccgacuacucuggucaguuuacccacaacaugaaucuggcuccggccgucgcaccuaacuucccaggcgagcaguugcuauuuuucagaucccagcugcccucaagugggggaaggagcaauggcauacucgacugccuggugccucaagaauggguacagcauuuuuaccaggaguccgcccccgcucagacacaaguugcccuugugcgguaugucaacccagauacuggucgagugcuguucgaggcaaaguugcacaaacucggguacaugaccaucgcgaagucuggcgacagcccuauuacagugcccccaaacggauauuuucgcuucgaaucaugggucaauccguucuacacccuggcuccuaugggcacugggaacggaagaaggcggauccaguga

SEQ ID NO: 17857 - RNA, 1623 nt, Artificial Sequence
  derived and/or modified sequence opt3 from capsid_protein_VP1__Norovirus__AII02569
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggugcucccgagcuacagugguagagauguucacaacgugcaucuggccccugcaguagcuccaacuuuucccggggagcaguuacuguucuuuaggucuacgaugccuggcuguuccggauaucccaauauggaccucgauugccuucugccacaggaguggguccagcacuucuaccaagaagcggccccugcacagagcgacguggcuuugcuacgguuuguuaaccccgauacaggccgugugcuguucgaguguaaacucuauaagucgggguacgucaccguggcccauacuggacagcacgaccugguaauuccaccgaaugguuauuuucgcuucgauucuugggugaaccaguucuacacccuugcaccuaugggcaacgggacaggaagaaggcgggcccuguga

SEQ ID NO: 17858 - RNA, 1623 nt, Artificial Sequence; identical to SEQ ID NO: 17655
  derived and/or modified sequence opt3 from capsid_protein_VP1__Norovirus__AII02572

SEQ ID NO: 17859 - RNA, 1623 nt, Artificial Sequence; identical to SEQ ID NO: 17655
  derived and/or modified sequence opt3 from capsid_protein_VP1__Norovirus__AII02575

SEQ ID NO: 17860 - RNA, 1623 nt, Artificial Sequence; identical to SEQ ID NO: 17698
  derived and/or modified sequence opt3 from capsid_protein_VP1__Norovirus__AII02578

SEQ ID NO: 17861 - RNA, 1647 nt, Artificial Sequence
  derived and/or modified sequence opt3 from capsid_protein_VP1__Norovirus__AII02581
augaagauggccagcaacgacgcugcacccuccaaugauggcgccgcggggcuggugccugagaucaacucugaagcuauggcccucgagccagucgcaggagccgcuauugcagccccgcuuaccggucagcaaaauauaaucgaccccuggauuaugaacaauuucguucaggcuccuggcggggaauuuacagugucaccaagaaacagucccggagagguacuguugaauuuagaacugggcccugagaucaacccauaccuagcccaccucgcgaggauguauaaugguuacgcagggggauucgaggugcagguccugcuugccggcaacgcuuuuacugccggcaaaauuaucuucgcagcuauacccccuaauuuuccaaucgauaaccugagcgccgcgcagauuacgaugugcccgcaugugaucguugacgugcggcaauuggaacccgucaaucucccuaugccagaugugcgcaacaauuucuuucacuauaaccagggguccgacucucgacugcgucugauugccaugcucuacacccccuuaagagcaaacaauucgggagaugacguauucacaguuucauguagggugcugacucggccuagcccagauuuuaguuucaacuuucuugugcccccgaccgucgaguccaagacaaaaccuuucucuuugcccauccugaccauaagcgaaauguccaauucacgcuuuccagugccuauugacagucuacauacuagccccacagagaacaucgucguucagugccagaaugguagagugacccucgauggcgagcugauggggacgacucaacuucugccaucucagauuugugcuuucaggggaauguugacccgguccacaucacgcgccagcgaccaggcugauacugccacaccccgacucuucaacuauuacuggcacauccagcuggacaauuuaaacggcaccccuuaugacccagcagaagauaucccggguccccuggggaccccugacuuuagaggaaagguauucggcguggccagucaaaggaauccagaugcuacgacucgggcgcaugaggcaaaaauugacacaaccucuggccguuuuacucccaagcucgggucccuugaaauaagcacagagucgggagauuucgaccagaaccagccuacccgcuuuacgccagucgguaucggcguggaucacgaagccgacuuccaacaguggacccugcccgauuacgcugggcaguuuacacacaauaugaacuuggccccggcaguugccccuaauuucccaggagagcagcuacuguuuuucagaucucaacuccccuccucaggcgguaggaguaacgggauucuggacugccuugugccucaggaguggguccagcauuuuuaccaggaaagcgcucccucccaaacucagguggcccugguacgguauguuaauccagauaccggccgaguguuguucgaggcaaagcuccacaaacugggauuuaugacaaucgcgaagucuggcgacagcccuauaacugugcccccaaacggguacuuccgcuucgaaucaugggucaacccguuuuauaccuuagcuccuaugggaacagguaauggcagaaggcggauucaguga

SEQ ID NO: 17862 - RNA, 1623 nt, Artificial Sequence
  derived and/or modified sequence opt3 from capsid_protein_VP1__Norovirus__AII02584
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagaccaacgacucgacaauuaaguugaucgcuaugcucuauacuccacugcgugccaacaaugcgggggaagauguguucaccgucucaugcagaguucugacaaggcccagcccggacuuugauuucauuuuucucgugccucccaccguagagagucggacuaaaccauucacagugccuaucuuaaccgucgaagagaugacgaacucccgcuuucccauaccacuggagaaacuuuucacuggacccucuagcgccuucgugguucagccucagaaugguagauguaccacagacggcguguugcuggggacuacccaacuauccccagucaacauuugcacauuuaggggagaugugacccauaucgcaggcucacggaauuacacgaugaaccucgcuagucugaauuggaacaauuaugacccgacugaagagauucccgccccucuugguacaccagauuucguagggaagauccagggaguucugacccagacuacaaagggcgacggcagcacccgcgggcacaaggcuacgguguacaccggaucugcccccuuuacaccuaaauuggguuccguccaguucucaacugacaccgaaaacgauuuugagacacaucaaaauacuaaguucaccccagugggcgucauccaggacgggggaacaacccaccgaaacgaaccccagcaaugggugcucccgagcuacaguggcagaaauguucacaacgugcaucuggccccugcaguagcuccaacuuuucccggugagcaguuacuguucuuuaggucuacgaugccuggguguuccggcuaucccaauauggaucucgacugccuucugccacaggaguggguccagcacuucuaccaagaagcggccccugcacagagcgauguggcuuugcuacgguuuguuaaccccgacacaggacgugugcuguucgaguguaaacuccauaagucgggcuaugucaccguggcccacacugggcagcacgaucugguaauuccaccgaacggauacuuucgcuucgacucuugggugaaucaguucuauacccuugcaccuauggguaacggcacagggagaaggcgggcccuguga

SEQ ID NO: 17863 - RNA, 1623 nt, Artificial Sequence; identical to SEQ ID NO: 17655
  derived and/or modified sequence opt3 from capsid_protein_VP1__Norovirus__AII02590

SEQ ID NO: 17864 - RNA, 1623 nt, Artificial Sequence; identical to SEQ ID NO: 17702
  derived and/or modified sequence opt3 from capsid_protein_VP1__Norovirus__AII02593

SEQ ID NO: 17865 - RNA, 1623 nt, Artificial Sequence; identical to SEQ ID NO: 17655
  derived and/or modified sequence opt3 from capsid_protein_VP1__Norovirus__AII02596

SEQ ID NO: 17866 - RNA, 1623 nt, Artificial Sequence
  derived and/or modified sequence opt3 from capsid_protein_VP1__Norovirus__AII02599
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgauaucacccauauugcagguucacgggacuacacgaugaaccucgcuagucugaauuggaacaauuaugauccgacugaagagauccccgccccucuugggacaccagacuucgugggaaagauccagggcguacugacccagacuacaaagcgcgacggcagcacccgagggcacaaggcuacgguuuacaccggaucugcccccuuuacaccuaaauuggguuccgugagauucucaacugauaccgaaaacgacuuugagacacaucagaauacuaaguucaccccagucggcgugauucaagaugggagcacaacccacaggaacgaaccccagcaguggguccucccgaguuacucuggacgggacgugcacaauguucaucuggccccugcaguggcuccaacuuuucccggcgagcaauuacuguucuuucguuccacgaugccugguuguagcggguaucccaacauggaucucgacugccuucugccacaggaguggguacagcacuucuaccaggaagcggccccugcacaaucggaugucgcuuugcuacgcuuugugaaucccgacacaggcagaguucuguucgaguguaaacuccauaagucuggauaugugaccgucgcccacacuggccagcacgaucuggugauaccaccgaacggguacuuuagguucgacuccuggguaaaucaguucuauacccuugcaccuaugggaaacgguacaggccggcgacgcgcccuguga

SEQ ID NO: 17867 - RNA, 1623 nt, Artificial Sequence; identical to SEQ ID NO: 17702
  derived and/or modified sequence opt3 from capsid_protein_VP1__Norovirus__AII02602

SEQ ID NO: 17868 - RNA, 1608 nt, Artificial Sequence
  derived and/or modified sequence opt3 from capsid_protein_VP1__Norovirus__AII02605
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggaggucuuguuaaaucuggaacuaggaccugagcucaacccauaccuggcccaccuuagccggauguauaauggcuacgcuggugggguggagguucaggugcuguuggccggaaacgcguucacggcaggcaaacucgucuuugccgcugugcccccucauuucccacuggaaaauaucuccccgggccagauuaccauguuuccccacguaaucauugauguucgcacacuggagccugugcucuuaccacugcccgacguccgaaacaauuucuuucauuauaaccagcaaaacgaaccucguaugagacuuguggccauguuguacacuccacugaggucuaaugggucgggagaugacguguucaccgucucaugccggguucuaacacgccccagcccggauuuugacuucaacuaucucgugccucccaccguagagaguaagacuaaaccauuuacacugccuauccuuaccauaggugagcugacuaauuccagauuccccgugccaaucgaugaauuguacacgucucccaacgagagccucgucgugcagccucagaaugggaggugugcacuggacggcgaauuacagggaaccacacaacugcucccaacugcuauuugcuccuuucggggccgcaucaaccagaagguuucaggugagaaucacguguggaacaugcaggucaccaauauuaacgggacaccguucgaucccaccgaagacgugccugccccacuuggaacgcccgauuucaguggcaaacuguuuggcguauugagccagcgagaccaugacaaugcguguagaucucacgaugccguuaucgcaacuaacuccgcuaaguucacaccuaagcuaggggccauacaaauuggaaccugggagcaggacgaugugcacaucaaucagccaacuaaauuuacacccgucggucuguucgagucagaaggcuuuaaccaauggacccucccgaauuauagcggggcucugacgcuuaacaugggacuggccccuccaguggcacccaccuucccuggcgagcagauuuuguuuuucaggagucauaucccccucaaggguggggucgccgacccagugaucgauugccuguuaccucaggaauggauucagcaccuguaccaagagucugcucccucccagacagacguugcgcuaauacgguuuacuaacccagauaccggccguguacucuucgaagcaaaacugcaucgcagcggauacaucacaguggccaauacuggcucgagaccgauugucgugccugcuaacggguauuuuagguucgacucuuggguuaaucaguuuuacucccuugcccccaugggaaccgguaacggccggcgacgcgugcaguga

SEQ ID NO: 17869 - RNA, 1647 nt, Artificial Sequence
  derived and/or modified sequence opt3 from capsid_protein_VP1__Norovirus__AII02608
augaagauggccagcaacgacgcugcacccuccaaugauggcgccgcggggcuggugccugagaucaacucugaagcuauggcccucgagccagucgcaggagccgcuauugcagccccgcuuaccggucagcaaaauauaaucgaccccuggauuaugaacaauuucguucaggcuccuggcggggaauuuacagugucaccaagaaacagucccggagagguacuguugaauuuagaacugggcccugagaucaacccauaccuagcccaccucgcgaggauguauaaugguuacgcagggggauucgaggugcaggucgugcuggccggcaacgcuuuuacugccggcaaaauuaucuucgcagcuauacccccuaauuuuccaaucgauaaccuuagcgccgcgcagauuacgaugugcccgcauguuaucguggacguccggcaacuggaacccgugaauuugccuaugccagauguacgcaacaauuucuuucacuauaaccagggguccgacucucgacuccgucugauugccaugcuguacacaccccucagagcaaacaauucgggagaugacguuuucaccgugucauguagggucuuaacucggccuagcccagauuuuaguuucaacuuucuggugcccccgaccguggaguccaagacaaaaccuuucucucuucccaucuugaccauaagcgaaauguccaauucacgcuuuccagucccuauugacagucugcauacuagccccacagagaacaucguugugcagugccagaaugguagaguaacccuagauggcgagcucauggggacgacucaacugcuuccaucucagauuugugcuuucaggggaaugcugacccgguccacaucacgcgccagcgaccaggcugauacugccacaccccgauuguucaacuauuacuggcacauccagcucgacaaucugaacggcaccccuuaugacccagcagaagauaucccgggucccuuagggaccccugacuuuagaggaaagguguucggcgucgccagucaaaggaauccagaugcuacgacucgggcgcaugaggcaaaaauugacacaaccucuggccguuuuacucccaagcuggggucccucgaaauaagcacagagucgggagauuucgaccagaaccagccuacccgcuuuacgccaguggguaucggcguugaucacgaagccgaccuucaacaguggacccugcccgauuacgcugggcaguucacacacaauaugaacuuggccccggcaguggccccuaauuuuccaggagagcagcuacuguucuuuagaucucaacuccccuccucaggcgguaggaguaacgggauucuggacugccuugucccucaggagugggugcagcauuucuaccaggaaagcgcucccucccaaacucagguagcccugguucgguaugugaauccagauaccggccgagucuuguuugaggcaaagcuccacaaacugggauucaugacaaucgcgaagucuggcgacagcccuauaacugugcccccaaacggguacuuucgcuucgaaucaugggucaacccguucuauaccuuagcuccuaugggaacagguaauggcagaaggcggauucaguga

SEQ ID NO: 17870 - RNA, 1623 nt, Artificial Sequence; identical to SEQ ID NO: 17709
  derived and/or modified sequence opt3 from capsid_protein_VP1__Norovirus__AII02614

SEQ ID NO: 17871 - RNA, 1653 nt, Artificial Sequence
  derived and/or modified sequence opt3 from capsid_protein_VP1__Norovirus__AII02623
augaagauggccagcaacgacgcuacccccuccaaugauggcgcagccaaccuggugccugaggcgaauaacgaagucauggcucucgagccaguugugggggccucuaucgcagccccgguagugggacagcaaaauauuauagaccccuggaucagagaaaacuucguccaggcuccucagggugaguuuacagugucaccaaggaauagucccggcgaaaugcuucugaacuuggaguuagggccugagcugaauccauaccuaagccaccucucccggauguauaacggauacgcaggcgguaugcagguucaagugguccuggccgggaaugcuuucacugccggaaagauuaucuuugcggcagugcccccucauuucccaguagauaacauuucugccgcucagaucacgaugugcccgcacguuauaguggacguccgccagcuugaacccgugcuguugccucucccagauauccgaaaucguuucuuucauuauaaccaggagaauacccccagaaugaggcugguggccaugcuguacacaccucuccgggcaaacucgggcgaagacgucuuuacuguuucaugucgcguguuaaccagaccagcucccgauuucgaguuuacauuccugguaccgccuaccguggagagcaagacuaaacccuuuacacuuccaauuuugacccugggcgaacuaaguaacuccagguucccugccgcgaucgacaugcucuauacggaucccaaugagucuauugucgugcaaccacagaacgggcggugcacucuggacggaacccuucaggguacaacucagcugguucccacccaaaucugugccuuucgcggcacauugauaagccagaccgcacgagcugccgauuccacggacuucccucagagagcuaggaaucacccacuccaugugcaagucaagaaccuggaugggacucaguacgacccgacagacgauauucccgccguguuaggagcaaucgacuucaaaggcaccguauuugguguugccucacagcgggaugugagugggacucaggaacaaggacacuaugcuacacgugcgcacgaggcacauauugacaccacggauccuaaguacgccccaaagcugggcaccauccucaucaaaagcgaaucuacagacuucaauacuaaccagcccauucgcuuuaccccugucggcaugggggauaauaacuggagacagugggagcuuccagacuacuccggaucacugacauugaauaugaaccuagcucccgccgugagcccgaguuucccuggugagaggauacuguuuuuccggucuaucgucccauccgcaggcggguauggaagcggcuacauugauugccucaucccccaggaaugggugcaacacuuuuaucaggaggccgcuccuucgcagucugccguugcacuggugcgauacguaaaucccgacacuggucgcaacauauucgaagcgaaacuucauagagagggguuucugaccgucgcuaauuccggcaacaauccaauugugguuccucccaacggauauuucagguuugaagccugggugaaccaguucuacacauuggcaccaaugggcucagggcaaggacggcgcagagcccaguga

SEQ ID NO: 17872 - RNA, 1623 nt, Artificial Sequence; identical to SEQ ID NO: 17655
  derived and/or modified sequence opt3 from capsid_protein_VP1__Norovirus__AII02626

SEQ ID NO: 17873 - RNA, 1647 nt, Artificial Sequence
  derived and/or modified sequence opt3 from capsid_protein_VP1__Norovirus__AII02629
augaagauggccagcaacgacgcugcacccuccaaugauggcgccgcggggcuggugccugagaucaacucugaagcuauggcccucgagccagucgcaggagccgcuauugcagccccgcuuaccggucagcaaaauauaaucgaccccuggauuaugaacaauuucguucaggcuccuggcggggaauuuacagugucaccaagaaacagucccggagagguacuguugaauuuagaacugggcccugagaucaacccauaccuagcccaccucgcgaggauguauaaugguuacgcagggggauucgaggugcaggucgugcuggccggcaacgcuuuuacugccggcaaaauuaucuucgcagcuauacccccuaauuuuccaaucgauaaccuuagcgccgcgcagauuacgaugugcccgcauguuaucguggacguccggcaacuggaacccgugaauuugccuaugccagauguacgcaacaauuucuuucacuauaaccagggguccgacucucgacuccgucugauugccaugcuguacacaccccucagagcaaacaauucgggagaugacguuuucaccgugucauguagggucuuaacucggccuagcccagauuuuaguuucaacuuucuggugcccccgaccguggaguccaagacaaaaccuuucucucuucccaucuugaccauaagcgaaauguccaauucacgcuuuccagucccuauugacagucugcauacuagccccacagagaacaucguugugcagugccagaaugguagaguaacccuagauggcgagcucauggggacgacucaacugcuuccaucucagauuugugcuuucaggggaaugcugacccgguccacaucacgcgccagcgaccaggcugauacugccacaccccgauuguucaacuauuacuggcacauccagcucgacaaucugaacggcaccccuuaugacccagcagaagauaucccgggucccuuagggaccccugacuuuagaggaaagguguucggcgucgccagucaaaggaauccagaugcuacgacucgggcgcaugaggcaaaaauugacacaaccucuggccguuuuacucccaagcuggggucccucgaaauaagcacagagucgggagauuucgaccagaaccagccuacccgcuuuacgccaguggguaucggcguugaucacgaagccgacuuccaacaguggacccuucccgauuacgcugggcaguuuacacacaauaugaaccuggccccggcaguggccccuaauuucccaggagagcaguugcuauuuuucagaucucaacugcccuccucaggcgguaggaguaacgggauucucgacugccuggucccucaggagugggugcagcauuuuuaccaggaaagcgcucccucccaaacucagguagcccuuguucgguaugugaauccagauaccggccgaguccuguucgaggcaaaguugcacaaacucggauuuaugacaaucgcgaagucuggcgacagcccuauaacugugcccccaaacggguacuuccgcuucgaaucaugggucaacccguuuuauacccuggcuccuaugggaacagguaauggcagaaggcggauucaguga

SEQ ID NO: 17874 - RNA, 1623 nt, Artificial Sequence; identical to SEQ ID NO: 17705
  derived and/or modified sequence opt3 from capsid_protein_VP1__Norovirus__AII02632

SEQ ID NO: 17875 - RNA, 1623 nt, Artificial Sequence; identical to SEQ ID NO: 17655
  derived and/or modified sequence opt3 from capsid_protein_VP1__Norovirus__AII02635

SEQ ID NO: 17876 - RNA, 1608 nt, Artificial Sequence; identical to SEQ ID NO: 17868
  derived and/or modified sequence opt3 from capsid_protein_VP1__Norovirus__AII02638

SEQ ID NO: 17877 - RNA, 1623 nt, Artificial Sequence; identical to SEQ ID NO: 17655
  derived and/or modified sequence opt3 from capsid_protein_VP1__Norovirus__AII02641

SEQ ID NO: 17878 - RNA, 1647 nt, Artificial Sequence; identical to SEQ ID NO: 17873
  derived and/or modified sequence opt3 from capsid_protein_VP1__Norovirus__AII02644

SEQ ID NO: 17879 - RNA, 1623 nt, Artificial Sequence; identical to SEQ ID NO: 17690
  derived and/or modified sequence opt3 from capsid_protein_VP1__Norovirus__AII02647

SEQ ID NO: 17880 - RNA, 1623 nt, Artificial Sequence; identical to SEQ ID NO: 17702
  derived and/or modified sequence opt3 from capsid_protein_VP1__Norovirus__AII02650

SEQ ID NO: 17881 - RNA, 1623 nt, Artificial Sequence
  derived and/or modified sequence opt3 from capsid_protein_VP1__Norovirus__AII02653
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuagucugaacuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggugcucccgagcuacagugguagagauguucacaacgugcaucuggccccugcaguagcuccaacuuuucccggggagcaguuacuguucuuuaggucuacgaugccuggcuguuccggauaucccaauauggaccucgauugccuucugccacaggaguggguccagcacuucuaccaagaagcggccccugcacagagcgacgcugccuugcuacgguuugugaaccccgauacaggccguguucuguucgaguguaaacuccauaagucgggguaugugaccgucgcacacacuggacagcacgaccuggugauuccaccgaaugguuacuuucgcuucgauucuuggguaaaccaguucuauacccuugccccuaugggcaacgggacaggaagaaggcgggcucuguga

SEQ ID NO: 17882 - RNA, 1647 nt, Artificial Sequence; identical to SEQ ID NO: 17873
  derived and/or modified sequence opt3 from capsid_protein_VP1__Norovirus__AII02656

SEQ ID NO: 17883 - RNA, 1623 nt, Artificial Sequence; identical to SEQ ID NO: 17655
  derived and/or modified sequence opt3 from capsid_protein_VP1__Norovirus__AII02659

SEQ ID NO: 17884 - RNA, 1647 nt, Artificial Sequence; identical to SEQ ID NO: 17873
  derived and/or modified sequence opt3 from capsid_protein_VP1__Norovirus__AII02662

SEQ ID NO: 17885 - RNA, 1623 nt, Artificial Sequence; identical to SEQ ID NO: 17655
  derived and/or modified sequence opt3 from capsid_protein_VP1__Norovirus__AII02665

SEQ ID NO: 17886 - RNA, 1623 nt, Artificial Sequence; identical to SEQ ID NO: 17655
  derived and/or modified sequence opt3 from capsid_protein_VP1__Norovirus__AII02668

SEQ ID NO: 17887 - RNA, 1623 nt, Artificial Sequence; identical to SEQ ID NO: 17655
  derived and/or modified sequence opt3 from capsid_protein_VP1__Norovirus__AII02671

SEQ ID NO: 17888 - RNA, 1623 nt, Artificial Sequence
  derived and/or modified sequence opt3 from capsid_protein_VP1__Norovirus__AII02674
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucauugugcagccucagaauggcagauguacuaccgacgggguuuugcugggaacaacucaacuauccccagugaacaucugcaccuuuaggggcgaugucacacauauugcagguucacggaauuacaccaugaaccucgcuagucugaauuggaacaauuaugacccgacggaagagauccccgccccucuugggacuccagauuucgugggaaagauccagggcguacugacacagaccacuaagggcgacgggagcacacgcggacacaaggcuaccguuuacacggguucugcccccuuuaccccuaaauugggcuccgugcaguucucaacagacacugaaaacgauuuugaggcacaucaaaauaccaaguucacaccagucggggugauucaggacggaggcacuacccaccgaaacgaaccccagcaauggguccucccgagcuacagugguagagaugugcacaauguucaucuggccccugcuguggcgccaacauuucccggggagcaguuacuguucuuuaggucuaccaugccuggcuguuccggauaucccaacauggaccucgauugccuucugccacaggaguggguacagcacuucuaccaagaagcagccccugcucagagcgacgucgccuugcuacgguuugugaaucccgauacuggccguguucuguucgaguguaaacuccauaagucgggguaugugacggucgcacacacaggacagcacgaccuggugauaccaccgaacgguuacuuucgcuucgauucuuggguaaaccaguucuauacccuugccccuaugggcaaugggacuggaagaaggcgggcucuguga

SEQ ID NO: 17889 - RNA, 1623 nt, Artificial Sequence; identical to SEQ ID NO: 17698
  derived and/or modified sequence opt3 from capsid_protein_VP1__Norovirus__AII02677

SEQ ID NO: 17890 - RNA, 1623 nt, Artificial Sequence
  derived and/or modified sequence opt3 from capsid_protein_VP1__Norovirus__AII02680
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagauuaaugacccaaccaucaaguugauugcuaugcucuauacaccccugcgugccaacaacgcgggggaagauguguucacugucucaugcagaguucugaccaggccgagcccugacuuugauuucaucuuucucgugcccccaacaguagagagucggaccaaaccuuucacugugcccauauuaacagucgaagagaugaccaauucccgcuuuccaauuccccuggagaaacuuuucacgggaccuucuggugccuucgugguucagccacagaacggcagauguacuaccgacgggguguugcugggaacaacucaacuaagcccggucaauaucugcaccuuuaggggcgaugugacacauauugcagguucccggaacuacaccaugaaucucgcuucacugaacuggaauaacuaugaccccacggaagagaucccugccccacuugggacucccgauuucguaggaaagauccagggcguucugacacagaccacuaagggcgacgggaguacacgcggacacaaggcuaccguguacacggguagcgccccuuuuaccccaaaauugggcucuguccaguucuccacagacacugaaaaugauuuugagacccaucaaaacacaaaguucacucccgugggggucauucaggacggaucaaccacacaccgaaaugaaccgcagcaaugggugcucccuagcuacaguggcagagauauacacaacguucaucuggcaccagccguggcucccaccuuuccuggugagcaguuacuguucuuuaggucuacuaugcccggguguuccggcuauccaaauauggaccucgauugccuucugccucaggaguggguacagcacuucuaccaagaagcggcacccgcccagagcgacgucgcuuugcuacgguuugugaacccagauacgggacguguucuguucgaguguaaacuccauaagucgggcuaugugacagucgcccacaccgggcagcacgaccuggugaucccgccuaauggauacuuucgcuucgauucuuggguaaaccaguucuauacucuugcacccauggguaacggcaccgggagaaggcgggcccuguga

SEQ ID NO: 17891 - RNA, 1623 nt, Artificial Sequence; identical to SEQ ID NO: 17655
  derived and/or modified sequence opt3 from capsid_protein_VP1__Norovirus__AII02683

SEQ ID NO: 17892 - RNA, 1623 nt, Artificial Sequence; identical to SEQ ID NO: 17655
  derived and/or modified sequence opt3 from capsid_protein_VP1__Norovirus__AII02689

SEQ ID NO: 17893 - RNA, 1623 nt, Artificial Sequence; identical to SEQ ID NO: 17742
  derived and/or modified sequence opt3 from capsid_protein_VP1__Norovirus__AII02692

SEQ ID NO: 17894 - RNA, 1623 nt, Artificial Sequence; identical to SEQ ID NO: 17705
  derived and/or modified sequence opt3 from capsid_protein_VP1__Norovirus__AII02695

SEQ ID NO: 17895 - RNA, 1623 nt, Artificial Sequence; identical to SEQ ID NO: 17655
  derived and/or modified sequence opt3 from capsid_protein_VP1__Norovirus__AII02698

SEQ ID NO: 17896 - RNA, 1623 nt, Artificial Sequence; identical to SEQ ID NO: 17655
  derived and/or modified sequence opt3 from capsid_protein_VP1__Norovirus__AII02701

SEQ ID NO: 17897 - RNA, 1623 nt, Artificial Sequence; identical to SEQ ID NO: 17655
  derived and/or modified sequence opt3 from capsid_protein_VP1__Norovirus__AII02707

SEQ ID NO: 17898 - RNA, 1623 nt, Artificial Sequence; identical to SEQ ID NO: 17709
  derived and/or modified sequence opt3 from capsid_protein_VP1__Norovirus__AII02710

SEQ ID NO: 17899 - RNA, 1647 nt, Artificial Sequence
  derived and/or modified sequence opt3 from capsid_protein_VP1__Norovirus__AII02713
augaagauggccagcaacgacgcugcacccuccaaugauggcgccgcggggcuggugccugagaucaacucugaagcuauggcccucgagccagucgcaggagccgcuauugcagccccgcuuaccggucagcaaaauauaaucgaccccuggauuaugaacaauuucguucaggcuccuggcggggaauuuacagugucaccaagaaacagucccggagagguacuguugaauuuagaacugggcccugagaucaacccauaccuagcccaccucgcgaggauguauaaugguuacgcagggggauucgaggugcaggucgugcuggccggcaacgcuuuuacugccggcaaaauuaucuucgcagcuauacccccuaauuuuccaaucgauaaccuuagcgccgcgcagauuacgaugugcccgcauguuaucguggacguccggcaacuggaacccgugaauuugccuaugccagauguacgcaacaauuucuuucacuauaaccagggguccgacucucgacuccgucugauugccaugcuguacacaccccucagagcaaacaauucgggagaugacguuuucaccgugucauguagggucuuaacucggccuagcccagauuuuaguuucaacuuucuggugcccccgaccguggaguccaagacaaaaccuuucucucuucccaucuugaccauaagcgaaauguccaauucacgcuuuccagucccuauugacagucugcauacuagccccacagagaacaucguugugcagugccagaaugguagaguaacccuagauggcgagcucauggggacgacucaacugcuuccaucucagauuugugcuuucaggggaaugcugacccgguccacaucacgcgccagcgaccaggcugauacugccacaccccgauuguucaacuauuacuggcacauccagcucgacaaucugaacggcaccccuuaugacccagcagaagauaucccgggucccuuagggaccccugacuuuagaggaaagguguucggcgucgccagucaaaggaauccagaugcuacgacucgggcgcaugaggcaaaaauugacacaaccucuggccguuuuacucccaagcuggggucccucgaaauaagcacagagucgggagauuucgaccagaaccagccuaccaucuuuacgccaguggguauuggcguugaucacgaagccgacuuccaacaguggacccuucccgauuacgcugggcaguuuacacacaauaugaaccuggccccggcaguggccccuaauuucccaggagagcaguugcuauuuuuccgcucucaacugcccuccucaggcgguagaaguaacgggauccucgacugccuggucccucaggagugggugcagcauuuuuaccaggaaagcgcucccucccaaacucagguagcccuuguuagguaugugaauccagauaccggccggguccuguucgaggcaaaguugcacaaacucggauuuaugacaauagcgaagucuggcgacagcccuauuacugugcccccaaacggguacuuccgauucgaaucaugggucaacccguuuuauacccuggcuccuaugggaacagguaauggccgcagaaggauccaguga

SEQ ID NO: 17900 - RNA, 1647 nt, Artificial Sequence; identical to SEQ ID NO: 17873
  derived and/or modified sequence opt3 from capsid_protein_VP1__Norovirus__AII02716

SEQ ID NO: 17901 - RNA, 1650 nt, Artificial Sequence
  derived and/or modified sequence opt3 from capsid_protein_VP1__Norovirus__AII02719
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuaaugcugcccagaucacuaugugcccgcacguuauaguggauguccgccagcuugagcccgugcuguugccucucccagacauccgaaacagauuuuuccauuauaaucaggaagauacgccccguaugaggcugguggcaaugcuguacaccccucuccgggcuaacucuggcgaggacgucuuuacaguuucgugucgcguguuaacuagaccagcccccgauuucgaguuuaccuuccugguaccgccuacaguggaaucaaagaccaaacccuuuacucuuccaauuuugacacugggcgagcuaagcaacaguagguucccugcgcccaucgacaugcucuauaccgauccaaaugaagggauugucgugcaaccccagaacggacggugcacgcuggacgguacucuucagggcaccacacagcugguuccuacucaaaucugugccuuucgcgggauauugauuggacagaccucccgaucuccagauagcgacuccacagauucagcaccgagaaggcgggaccacccccuccauaugcagcuggagaauuuagacggcacccaauacgauccuacggacgaagugccagcugcccugggugcugucgauuucaaggggacuaucuucggaguggccagucagcgugacacaagcggcacccagguaggcgcaacucgcgcccacgagguuauuaucaacacaaccgaucccagauauacgccuaaacucgggucugugcuuauguacuccgagucacaggacuuugaaaccggacaaccaaucagguucacacccauugguaugggcgagaaugauuggcaccagugggaacugccgaacuacagcgggcgguugacucuaaauaugaaccuggcuccugcggucgcaccagccuuucccggagagcgaauacucuucuuucgcaguaucgugccuucugcuggcgguuauggguccggccagauugacugccugcuuccccaggaauggguccaacauuucuaccaggaggccgcaccaagccagucggccguggcucugaucagauauguuaauccugauaccggaaggaacauauuugaggccaaguugcaccgggaaggcuucauuacaguggcaaauucugggaacaaucccaucguagucccaccgaacggauacuuucgcuucgaggcgugggugaaucaguuuuauacucucaccccuauggguacaggccaagggagaaggcguaaccaguga

SEQ ID NO: 17902 - RNA, 1650 nt, Artificial Sequence
  derived and/or modified sequence opt3 from capsid_protein_VP1__Norovirus__AII02722
augaagauggccagcaacgacgcugcacccuccaaugauggcgccgcgaaccuggugccugaggcuaauaacgaagucauggcccucgagccaguugcaggggccucuaucgcugcaccggugguaggacagcaaaauauuauagaccccuggaucagagaaaacuucgugcaggccccucagggugaguuuaccgucucaccaaggaauagucccggcgaaaugcuucugaacuuggaguuagggccugagcugaauccauaccuaagccaccucucccggauguauaacggauacgcuggcgguaugcagguccaaguugugcuggccgggaaugcguucacagcaggaaaaauuaucuuugccgcugugcccccucauuucccaguggaaaacauuaaugccgcacagaucacuaugugcccgcacguaauaguugaugugcgccagcuugagcccguccuguugccucucccagacauccgaaacagauuuuuccauuauaaucaggaagauacgccccguaugaggcugguggcuaugcuguacaccccucuccgggccaacucuggcgaggacguguuuacagucucgugucgcguuuuaacuagaccagcgcccgauuucgaguuuaccuuccuggugccgccuacaguagaaucaaagaccaaacccuuuacucuuccaauuuugacacugggcgagcuaagcaacaguagguucccugcccccaucgacaugcucuauaccgauccaaaugaagggauugugguccaaccccagaacggacggugcacgcuggacgguacucuucagggcaccacacagcuggugccuacucaaaucugugcauuucgcgggcgauugauaggacagaccuccagaucuccagaucucgacagcacagauuccgcuccgaggcggcgugaccacccccugcauaugcaguuagagaaucuggacggcacccaauacgauccuacggacgaaguuccagccgcucucggugccguggauuucaaggggacuauuuucggagucgcaucacagcgcgacacaaguggcagccaggugggcgccaccagagcucacgagguaacuaucaacacaaccgaucccagguauacgccuaaacuugggucuguucugauguacuccgagucacaggacuuugaaaccggacaaccaauucgguucacacccaucgguaugggcgaggaugacuggcaccagugggaauugccgaauuacagcgggcgacuaacucugaacaugaaucucgcgccugcaguggccccagcuuuucccggagagcgcauccuguucuuuagaaguauugucccuucugccggcgguuauggguccggccagauagauugccuucugccccaggaaugggugcaacauuucuaccaggaggcagccccaagccagucggcugucgccuugaucagguaugugaacccugacaccggacggaauauuuuugaggcaaagcuccaccgcgaaggcuucaucacaguugcgaacucugggaauaaccccauagugguaccaccgaauggauacuuuagauucgaggcuugggucaaccaguuuuauacucugaccccuauggguacaggccaagggaggcgucggaaucaguga

SEQ ID NO: 17903 - RNA, 1623 nt, Artificial Sequence
  derived and/or modified sequence opt3 from capsid_protein_VP1__Norovirus__AII02725
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccgugccacuggagaaacuuuucacgggacccagcggugccuucguugugcagccucagaacggcagauguaccacagacggggucuugcugggaacuacccaacuauccccagugaauauaugcacauuuaggggcgauguaacccauauugcagguucacggaacuacacgaugaaucucgcuagucugaacuggaauaacuaugacccgacugaagagauccccgccccucuugggacaccagauuucguuggaaagauucagggcgugcugacccagacuacaaagggcgacgggagcacccgcggacacaaggcuacggucuacaccgguucugcccccuuuacaccuaaauugggcuccgugcaguucucaacugacaccgaaaaugauuuugagacacaucaaaacacuaaguucaccccagucggggugauccaggacggaggcacaacccaccgaaaugaaccccagcaauggguucucccgagcuacagugguagagaugugcacaacguacaucuggccccugcagucgcuccaacuuuucccggggagcaguuacuguucuuuaggucuacgaugccuggcuguuccggauaucccaauauggaccucgauugccuucugccacaggagugggugcagcacuucuaccaagaagcggccccugcacagagcgacguugcuuugcuacgguuugugaaccccgauacaggccguguccuguucgaguguaaacuccauaagucgggguaugugaccguagcccacacuggacagcacgaccuggugaucccaccgaaugguuacuuucgcuucgauucuuggguuaaccaguucuauacccuugcaccuaugggcaacgggacaggaagaaggcgggcccuguga

SEQ ID NO: 17904 - RNA, 1623 nt, Artificial Sequence
  derived and/or modified sequence opt3 from capsid_protein_VP1__Norovirus__AII02728
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacccaacaauuaaguugaucgcuaugcucuauacuccccugcgugccaacaacgcgggggaagauguguucaccgucucaugcagaguucugacaaggccgagcccugacuuugauuucauuuuucucgugcccccaaccguagagagucggacuaaaccuuucacagugcccaucuuaaccgucgaagagaugacuaauucccgcuuuccaauaccccuggagaaacuuuucacgggaccuucuggugccuucgugguucagccacagaacggcagauguaccacagacgggguguugcugggaacuacccaacuaagcccggucaauauuugcacauuuaggggcgaugugacccauaucgcagguucccgggacuacacgaugaaccucgcuucacugaauuggaacaauuaugaucccacugaagagauuccugccccacuugggacacccgacuucguaggaaagauccagggcguucugacccagacuacacgcggcgacgggaguacccgaggacacaaggcuacgguguacaccgguagcgccccuuuugcaccaaaguugggcucuguccaguucuccacagauacugaaaacgacuuugagacccaucaaaauacaaaauucacucccgugggggucauccaggauggaggcaccacacacagaaacgaaccgcagcaaugggugcucccuucauacagcgguagggacguucacaaugugcaucuggccccagcuguagcgcccaccuuuccuggggagcaguuacuguucuuucggaguacuaugcccggcuguucuggauauccaaacauggaucucgacugccuucugccucaggaguggguccagcacuucuaccaagaagcagcccccgcucaguccgauguggccuugcuacguuuuguuaauccagacacgggccgcgugcuguucgaguguaagcuccauaaaagcggguaugucacaguggcacacaccggacagcacgaucugguaauuccgccuaacgguuacuuuagauucgacucgugggugaaucaguucuauacucuugcccccaugggcaacgggaccggaaggcggcgagcucuguga

SEQ ID NO: 17905 - RNA, 1653 nt, Artificial Sequence
  derived and/or modified sequence opt3 from capsid_protein_VP1__Norovirus__AII02731
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagauaacauuucugcugcccagaucacuaugugcccgcacguuauaguggacguccgccagcuugaacccgugcuguugccucucccagauauccgaaauagauuuuuccauuauaaccaggagaauacgccccguaugaggcugguggcaaugcuguacaccccucuccgggcuaacucgggcgaagacgucuuuacaguuucaugucgcguguuaacuagaccagcccccgauuucgaguuuaccuuccugguaccgccuacaguggagagcaagaccaaacccuuuacucuuccaauuuugacacugggcgaacuaaguaacuccagguucccugcggccaucgacaugcucuauaccgaucccaaugagucuauugucgugcaaccacagaacgggcggugcacgcuggacggaacucuucaggguaccacacagcugguucccacucaaaucugugcauuucgcggcaccuugauaagccagacagcucgagccgcugauuccaccgacucaccucagagagccaggaaucacccacuccaugugcaagucaagaaccuggaugggacgcaguacgacccgacugacgauauucccgcaguguuaggagccaucgacuucaaaggcacaguauucgguguugcuagucagcgggaugugagcgggacccaggaacaaggacacuaugcgacucgugcacacgaggcccauauugacacaaccgauccuaaguacgcuccaaagcugggcacgauccucaucaaaucugaauccaccgacuuuaauacaaaccagcccauucgcuucacuccugucggcaugggggauaauaacuggagacagugggagcuuccagacuacucaggaagccugaccuugaauaugaaccuagcccccgcagugaguccgucuuuuccuggugagaggauacuguucuuucgguccaucgucccaagcgccggcggguauggaucgggcuacauugauugccucaucccccaggaaugggugcaacacuucuaucaggaggcugccccuucucaguccgcaguugcgcuggugcgauacguaaaucccgacacaggucgcaacauauuugaagcuaaacuucauagagagggguuccugacugucgccaauucaggcaacaauccaauugugguuccucccaacggauauuuuagguucgaagcaugggugaaccaguuuuacaccuuggccccaaugggcagugggcaaggacggcgcagagcucaguga

SEQ ID NO: 17906 - RNA, 1623 nt, Artificial Sequence; identical to SEQ ID NO: 17655
  derived and/or modified sequence opt3 from capsid_protein_VP1__Norovirus__AII02734

SEQ ID NO: 17907 - RNA, 1623 nt, Artificial Sequence; identical to SEQ ID NO: 17655
  derived and/or modified sequence opt3 from capsid_protein_VP1__Norovirus__AII02737

SEQ ID NO: 17908 - RNA, 1623 nt, Artificial Sequence
  derived and/or modified sequence opt3 from capsid_protein_VP1__Norovirus__AII02740
augaagauggcccccaacgacgcuaauccuagcgauggcuccgcagccaaccuggugccagaggucucuaaugaaguuauggcgcucgagccggugguaggggcugccaucgcagcccccguggcuggacagcaaaacgucauugacccuuggauaagaaauaacuucgugcaggcaccagguggcgaauuuaccguuucacccaggaaugccccuggggagauccuuuggggagcuccacugggccccgauuugaacccuuacuuaagucaccuggcccggauguauaaugguuacgcagggggauucgaagugcaggucauucuagcgggcaacgccuuuacagcuggcaaaaucauuuucgccgcagugccaccgaauuuucccacugaggggcucagcccuucccagguaacgauguucccacauaucauaguugacgugcgccaacuggagcccguccuuaucccucugccagaugugcgaaacaauuuuuaucacuacaaccagaccaaugacucuacaauuaaguugaucgcuaugcucuauacuccccugcgugccaacaacgcgggagaagauguguucaccgucucgugcagaguucugacaaggccgucaccugacuuugauuucauuuuucucgugcccccaaccguagagagccggacuaaaccuuucacagugcccaucuuaaccgucgaagagaugacgaauagucgcuuuccaauaccccuggagaaacuuuucacugguccuuccggcgccuucgugguucagccacagaacgggagauguaccacagacggaguguugcugggcacuacccaacuaucuccggucaauauuugcacauuuaggggugaugugacccauaucgcagggagccggaacuacacgaugaaucucgcuucccugaacuggaauaacuaugaccccacugaagagauuccugccccacuuggaacacccgauuucguaggcaagauccagggcguucugacccagacuacaaagggggacggaucaacccgcggucacaaggcuacgguguacaccggcagugccccuuuuacaccaaaauuggggagcguccaguucucuacugacaccgaaaaugauuuugagacacaucaaaacacuaaguucacccccgugggagucauccaggacggcgguacaacccaccgaaaugaaccgcagcaaugggugcucccuuccuacucagggagagauguucacaacgugcaucuggcaccagccguagcucccacuuuuccuggcgagcaguuacuguucuuuaggagcacgaugcccggauguaguggcuauccaaauauggaccucgauugccuucugccucaggaguggguccagcacuucuaccaagaagcggcacccgcccagucugacguggcuuugcuacgguuuguuaacccagauacagggcgugugcuguucgaguguaaacuccauaaguccggauaugucaccguggcccacaauggucagcacgaccugguaauuccgccuaacggcuacuuucgcuucgauagcugggugaaccaguucuauacucuugcacccauggggaauggaaccggcagaaggcgggcccuguga

SEQ ID NO: 17909 - RNA, 1623 nt, Artificial Sequence; identical to SEQ ID NO: 17688
  derived and/or modified sequence opt3 from capsid_protein_VP1__Norovirus__AII02743

SEQ ID NO: 17910 - RNA, 1623 nt, Artificial Sequence; identical to SEQ ID NO: 17888
  derived and/or modified sequence opt3 from capsid_protein_VP1__Norovirus__AII02746

SEQ ID NO: 17911 - RNA, 1623 nt, Artificial Sequence; identical to SEQ ID NO: 17655
  derived and/or modified sequence opt3 from capsid_protein_VP1__Norovirus__AII02749

SEQ ID NO: 17912 - RNA, 1623 nt, Artificial Sequence; identical to SEQ ID NO: 17737
  derived and/or modified sequence opt3 from capsid_protein_VP1__Norovirus__AII02752

SEQ ID NO: 17913 - RNA, 1623 nt, Artificial Sequence; identical to SEQ ID NO: 17702
  derived and/or modified sequence opt3 from capsid_protein_VP1__Norovirus__AII02758

SEQ ID NO: 17914 - RNA, 1623 nt, Artificial Sequence
  derived and/or modified sequence opt3 from capsid_protein_VP1__Norovirus__AII02761
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucaucugaucguugacgugcgccaacuugagccaguccugauacccuugccugaugugcgaaacaauuuuuaucacuacaaccagucaaaugacccaacaaucaagcucauugcaaugcuguauacuccccugcgugcuaacaacgccggggaugacguguucaccgucagcugcagaguucucacaaggccgaguccugauuuugacuucaucuuuuuagugcccccaaccguagaaucccggacuaaaccuuucucugugcccguccugacaguggaggaaaugaccaauagccgcuuuccaauuccccuugagaaguuguucacgggaccuuccucagcguucguugugcagccacagaacgguagauguacuaccgauggcguccugcuagggacaacucaacucaguccggugaauaucugcaccuuuaggggagacguaacacauauaagcggcucucggaacuacaccaugaaucuggccucccagaacuggaacucauaugaucccacggaggaaauuccugcaccacuugguacucccgacuucguugggaaaauccagggagugcugacacagaccacucgcacaaauggcagcacccgaggccacaaggcuacggucuacaccgggagugccgacuuuucuccuaaguugggaagagugcaauucgcuacagauacugacaaugauuuugagaccaaccagaauacaaaauucacuccagucggugugauucaggacggcuccaccacacccaggaacgaaccgcaacaguggguucucccuagcuacucggggcggaauauccauaacgugcaccuggccccagcaguagcccccaccuuuccuggagagcaguuacuguucuuucguucuacuaugcccggcuguuccgguuauccaaauauggaucucgacugccuucugccucaggaauggguccaauacuucuaucaggaggcugcgcccgcacagucagauguggccuugcuacgcuuuguuaacccagacacggggagagugcuguucgaguguaagcuccacaaaaguggcuacgucacaguggcucauaccggacagcacgaucugguaaucccgccuaacggcuauuuuagguucgacagcugggugaaucaauucuacacucuugcccccauggggaacggaaccggucggcgacgcgcacuguga

SEQ ID NO: 17915 - RNA, 1623 nt, Artificial Sequence; identical to SEQ ID NO: 17655
  derived and/or modified sequence opt3 from capsid_protein_VP1__Norovirus__AII02764

SEQ ID NO: 17916 - RNA, 1623 nt, Artificial Sequence; identical to SEQ ID NO: 17655
  derived and/or modified sequence opt3 from capsid_protein_VP1__Norovirus__AII02767

SEQ ID NO: 17917 - RNA, 1647 nt, Artificial Sequence; identical to SEQ ID NO: 17873
  derived and/or modified sequence opt3 from capsid_protein_VP1__Norovirus__AII02770

SEQ ID NO: 17918 - RNA, 1623 nt, Artificial Sequence; identical to SEQ ID NO: 17655
  derived and/or modified sequence opt3 from capsid_protein_VP1__Norovirus__AII02773

SEQ ID NO: 17919 - RNA, 1650 nt, Artificial Sequence
  derived and/or modified sequence opt3 from capsid_protein_VP1__Norovirus__AII02776
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuaaugcugcccagaucacuaugugcccgcacguuauaguggauguccgccagcuugagcccgugcuguugccucucccagacauccgaaacagauuuuuccauuauaaucaggaagauacgccccguaugaggcugguggcaaugcuguacaccccucuccgggcuaacucuggcgaggacgucuuuacaguuucgugucgcguguuaacuagaccagcccccgauuucgaguuuaccuuccugguaccgccuacaguggaaucaaagaccaaacccuuuacucuuccaauuuugacacugggcgagcuaagcaacaguagguucccugcgcccaucgacaugcucuauaccgauccaaaugaagggauugucgugcaaccccagaacggacggugcacgcuggacgguacucuucagggcaccacacagcugguuccuacucaaaucugugccuuucgcgggauauugauuggacagaccucccgaucuccagauagcgacuccacagauucagcaccgagaaggcgggaccacccccuccauaugcagcuggagaauuuagacggcacccaauacgauccuacggacgaagugccagcugcccugggugcugucgauuucaaggggacuaucuucggaguggccagucagcgugacacaagcggcucucagguaggcgcaacccgcgcccacgagguuauuaucaacacuacagaucccagauauaccccuaaacucggguccgugcuuauguacucagagagccaggacuuugaaacgggacaaccaaucagguucacccccauugguaugggcgagaaugauuggcaccagugggaacugccgaacuacagugggcgguugacacuaaauaugaaccuggcuccugcggucgcaccagccuuucccggagagcgaauacucuucuuucgcucuaucgugccuuccgcuggcgguuaugggagcggccagauggacugccugcuuccccaggaauggauucaacauuucuaccaggaggccgcaccaucgcagucugccgucgcucugaucagauaugugaauccugauacuggaaggaacauauuugaggccaaguugcaccgggaaggcuucauuaccguugcaaauuccgggaacaaucccaucgugguaccaccgaacggauacuuucgcuucgaggcgugggucaaucaguuuuauacacucacuccuauggguaccggccaagggagaaggcguaaccaguga

SEQ ID NO: 17920 - RNA, 1623 nt, Artificial Sequence; identical to SEQ ID NO: 17655
  derived and/or modified sequence opt3 from capsid_protein_VP1__Norovirus__AII02779

SEQ ID NO: 17921 - RNA, 1623 nt, Artificial Sequence; identical to SEQ ID NO: 17655
  derived and/or modified sequence opt3 from capsid_protein_VP1__Norovirus__AII02782

SEQ ID NO: 17922 - RNA, 1623 nt, Artificial Sequence
  derived and/or modified sequence opt3 from capsid_protein_VP1__Norovirus__AII02785
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagaccaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcggugccuucgugguucagccucagaacggcagauguaccacagacgggguguugcugggaacuacccaacuauccccagucaauauuugcacauuuaggggcgaugugacccauaucgcagguucacggaacuacacgaugaaucucgcuaguauuaacuggaauaacuaugacccgacugaagagauccccgccccucuggggacaccagauuucguaggaaagauccagggcguucuuacccagacuacaaagggcgacgggagcacccgcggacacaaggcuacgguguacaccgguucugcccccuuuacaccuaaacugggcuccguccaguucucaacugacaccgaaaaugauuuugagacacaucaaaacacuaaguucaccccagugggggucauucaggacggaggcacaacccaccgaaaugaaccccagcaauggguguugccgagcuacagugguagagauguucacaacgugcaucucgccccugcaguagcuccaacuuuucccggggagcagcuguuauucuuuaggucuacgaugccuggcuguuccggauaucccaauauggaccuggauugccuccuuccacaggaguggguccagcacuucuaccaagaagcggccccugcacagagcgacgcugcccuguugcgguuugugaaccccgauacaggccguguucuauucgaguguaaacugcauaagucgggguaugugaccgucgcacacacuggacagcacgaccucgugauaccaccgaaugguuacuuucgcuucgauucuuggguaaaccaguucuauacccuggccccuaugggcaacgggacaggaagaaggcgggcucuuuga

SEQ ID NO: 17923 - RNA, 1647 nt, Artificial Sequence; identical to SEQ ID NO: 17873
  derived and/or modified sequence opt3 from capsid_protein_VP1__Norovirus__AII02788

SEQ ID NO: 17924 - RNA, 1647 nt, Artificial Sequence; identical to SEQ ID NO: 17873
  derived and/or modified sequence opt3 from capsid_protein_VP1__Norovirus__AII02791

SEQ ID NO: 17925 - RNA, 1623 nt, Artificial Sequence
  derived and/or modified sequence opt3 from capsid_protein_VP1__Norovirus__AII02794
augaagauggccagcuccgacgcuaaccccucugauggcucaaccgcaagucuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucgugcuagcgggaaaugcauuuacugccggcaaaauuaucuucgcugccguaccuccaaacuuuccgacggagggccucucgcccucacagguuaccauguucccucauauuaucguggacguccgccaacuggagccagugcuuauaccccugccugaugugcgaaauaacuuuuaucacuacaaucagagcaacgacccaacaaucaaguugauugcaaugcucuauacuccccugcgugcuaauaacgccggggaugacgucuucaccguuaguugcagagugcugacaaggccguccccugauuuugacuucaucuuucucguacccccaaccguggaaucucggacuaaaccuuucagcguccccguguuaacaguugaggaaaugaccaacucccgcuuuccaauuccccuggagaaacuuuucacgggaccuucaagugcguucgugguccagccacagaaugguagauguacuaccgauggcguguugcuggggacaacucaacuaagcccgguaaacaucugcaccuuuaggggagacguuacacauauaucuggcucccggaauuacaccaugaaccucgccucacagagcuggaauaguuaugaucccacggaggaaauuccugcaccacuggguucucccgacuucguggggaagauccagggaguccuuacucagacaacccgcacuaacggcuccacacgaggccacaaggcuaccguguacacggggagcgccgacuuuucgccuaagcugggaagaguccaauucgcuaccgauacagacaaugauuuugagacuaaccagaauaccaaauucacaccaguggguguuauucaggacggcucuacuacccccaggaacgaaccgcaacaguggguguugccuuccuacucagggcggaauauccauaacguacaccucgccccagcagucgcccccacauuuccuggagagcagcuguuauucuuucguaguaccaugcccggcuguagcgguuauccaaauauggaucuggacugccuccuuccucaggaaugggugcaauacuucuaucaggaggcugcgcccgcacaguccgauguugcccuguugcgcuuugugaacccagacacugggagaguccuauucgaguguaagcugcacaaaucuggcuacgugacgguagcucauacaggacagcacgaucucgugaucccgccuaauggcuauuuuagguucgacagcuggguuaaccaauucuacacccuggcccccauggggaacggaacuggucggcgacgcgcacuuuga

SEQ ID NO: 17926 - RNA, 1623 nt, Artificial Sequence; identical to SEQ ID NO: 17655
  derived and/or modified sequence opt3 from capsid_protein_VP1__Norovirus__AII02797

SEQ ID NO: 17927 - RNA, 1623 nt, Artificial Sequence; identical to SEQ ID NO: 17655
  derived and/or modified sequence opt3 from capsid_protein_VP1__Norovirus__AII02800

SEQ ID NO: 17928 - RNA, 1623 nt, Artificial Sequence; identical to SEQ ID NO: 17904
  derived and/or modified sequence opt3 from capsid_protein_VP1__Norovirus__AII02803

SEQ ID NO: 17929 - RNA, 1623 nt, Artificial Sequence; identical to SEQ ID NO: 17655
  derived and/or modified sequence opt3 from capsid_protein_VP1__Norovirus__AII02806

SEQ ID NO: 17930 - RNA, 1623 nt, Artificial Sequence; identical to SEQ ID NO: 17888
  derived and/or modified sequence opt3 from capsid_protein_VP1__Norovirus__AII02809

SEQ ID NO: 17931 - RNA, 1647 nt, Artificial Sequence; identical to SEQ ID NO: 17873
  derived and/or modified sequence opt3 from capsid_protein_VP1__Norovirus__AII02812

SEQ ID NO: 17932 - RNA, 1623 nt, Artificial Sequence
  derived and/or modified sequence opt3 from capsid_protein_VP1__Norovirus__AII02815
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucauugugcagccucagaauggcagauguacuaccgacgggguuuugcugggaacaacucaacuauccccagugaacaucugcaccuuuaggggcgaugucacacauauugcagguucacgggacuacaccaugaaucucgcuagucugaacuggaauaacuaugauccgacggaagagauccccgccccucuugggacuccagacuucgugggaaagauccagggcguacugacacagaccacuaagggcgacgggagcacacgcggacacaaggcuaccguuuacacggguucugcccccuuuaccccuaaauugggcuccgugcaguucucaacagauacugaaaaugacuuugaggcacaucaaaacaccaaguucacaccagucggggugauucaggauggaggcacuacccaccgaaaugaaccccagcaauggguccucccgagcuacagugguagagacgugcacaacguucaucuggccccugcuguggcgccaacauuucccggggagcaguuacuguucuuuaggucuaccaugccuggcuguuccggauaucccaauauggaucucgacugccuucugccacaggaguggguacagcacuucuaccaagaagcagccccugcucagagcgaugucgccuugcuacgguuugugaaccccgacacuggccguguucuguucgaguguaaacuccauaagucgggguaugugacggucgcacacacaggacagcacgaucuggugauaccaccgaaugguuacuuucgcuucgacucuuggguaaaccaguucuauacccuugccccuaugggcaacgggacuggaagaaggcgggcucuguga

SEQ ID NO: 17933 - RNA, 1647 nt, Artificial Sequence
  derived and/or modified sequence opt3 from capsid_protein_VP1__Norovirus__AII02818
augaagauggccagcaacgacgcugcacccuccaaugauggcgccgcggggcuggugccugagaucaacucugaagcuauggcccucgagccagucgcaggagccgcuauugcagccccgcuuaccggucagcaaaauauaaucgaccccuggauuaugaacaauuucguucaggcuccuggcggggaauuuacagugucaccaagaaacagucccggagagguacuguugaauuuagaacugggcccugagaucaacccauaccuagcccaccucgcgaggauguauaaugguuacgcagggggauucgaggugcaggucgugcuggccggcaacgcuuuuacugccggcaaaauuaucuucgcagcuauacccccuaauuuuccaaucgauaaccuuagcgccgcgcagauuacgaugugcccgcauguuaucguggacguccggcaacuggaacccgugaauuugccuaugccagauguacgcaacaauuucuuucacuauaaccagggguccgacucucgacuccgucugauugccaugcuguacacaccccucagagcaaacaauucgggagaugacguuuucaccgugucauguagggucuuaacucggccuagcccagauuuuaguuucaacuuucuggugcccccgaccguggaguccaagacaaaaccuuucucucuucccaucuugaccauaagcgaaauguccaauucacgcuuuccagucccuauugacagucugcauacuagccccacagagaacaucguugugcagugccagaaugguagaguaacccuagauggcgagcucauggggacgacucaacugcuuccaucucagauuugugcuuucaggggaaugcugacccgguccacaucacgcgccagcgaccaggcugauacugugacaccccgauuguucaacuauuacuggcacauccagcucgacaaucugaacggcaccccuuaugacccagccgaagauaucccgggucccuuagggaccccugacuuuagaggaaaggucuucggcguggcaagucaaaggaauccagaugccacgacucgggcucaugaggcgaaaauugacacaaccucuggccguuuuacucccaagcuggggucccucgaaauaagcacagagucggaugacuucuaccagaaccagccuacccgcuuuacgccaguuggaaucgguguggaucacgaagcagacuuccaacaguggacccuucccgauuacgccggccaguuuacacacaauaugaaccuggcuccggccgucgcaccuaauuucccaggggagcaguugcuauuuuucagaucucaacugcccuccucaggaggcaggaguaacgguauucucgacugccuggugccucaggaguggguacagcauuuuuaucaggaaagcgcccccucccaaacucagguugcucuugugcgguacgucaauccagauaccgggcgagugcuguucgaggccaaguugcacaaacucggcuuuaugacaaucgcaaagaacggagacucuccuauaacugugcccccaaacggcuauuuccgcuucgaaagcugggucaauccguuuuacacccuggcgccuauggggacaggaaacgguagaaggcggauucaguga

SEQ ID NO: 17934 - RNA, 1623 nt, Artificial Sequence
  derived and/or modified sequence opt3 from capsid_protein_VP1__Norovirus__AII02821
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucauugugcagccucagaauggcagauguacuaccgacgggguuuugcugggaacaacucaacuauccccagugaacaucugcaccuuuaggggcgaugucacacauauugcagguucacggaauuacaccaugaaccucgcuagucugaauuggaacaauuaugacccgacggaagagauccccgccccucuugggacuccagauuucgugggaaagauccagggcguacugacacagaccacuaagggcgacgggagcacacgcggacacaaggcuaccguuuacacggguggcgcccccuuuaccccuaaauuggggucugugcaguucuccacagacacugaaaacgauuuugaggcacaucaaaauaccaaguucacaccagucggagugauucaggacggcgguacuacccaccgaaacgaaccccagcaauggguccucccgucauacagcgggagagaugugcacaauguucaucuggccccugcuguggcgccaacauuucccggcgagcaguuacuguucuuuaggaguaccaugccuggauguucuggcuaucccaacauggaccucgauugccuucugccacaggaguggguacagcacuucuaccaagaagcagccccugcucaguccgacgucgccuugcuacgguuugugaaucccgauacugggcguguucuguucgaguguaaacuccauaagagcggauaugugacggucgcacacacaggucagcacgaccuggugauaccaccgaacggcuacuuucgcuucgauucguggguaaaccaguucuauacccuugccccuauggggaauggaacuggcagaaggcgggcucuguga

SEQ ID NO: 17935 - RNA, 1623 nt, Artificial Sequence; identical to SEQ ID NO: 17655
  derived and/or modified sequence opt3 from capsid_protein_VP1__Norovirus__AII02824

SEQ ID NO: 17936 - RNA, 1623 nt, Artificial Sequence; identical to SEQ ID NO: 17655
  derived and/or modified sequence opt3 from capsid_protein_VP1__Norovirus__AII02827

SEQ ID NO: 17937 - RNA, 1623 nt, Artificial Sequence; identical to SEQ ID NO: 17655
  derived and/or modified sequence opt3 from capsid_protein_VP1__Norovirus__AII02830

SEQ ID NO: 17938 - RNA, 1623 nt, Artificial Sequence
  derived and/or modified sequence opt3 from capsid_protein_VP1__Norovirus__AII02833
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucauugugcagccucagaauggcagauguacuaccgacgggguuuugcugggaacaacucaacuauccccagugaacaucugcaccuuuaggggcggugucacacauauugcagggucacggaauuacaccaugaaccucgcuagucugaauuggaacaauuaugauccgacggaagagauccccgccccucuuggaacuccagacuucgugggcaagauccagggcguacugacacagaccacuaagggggauggaagcacacgcggucacaaggcuaccguuuacacgggcucugcccccuuuaccccuaaauugggguccgugcaguucucaacagacacugaaaacgacuuugaggcacaucaaaauaccaaguucacaccagucggagugauucaggauggcgguacuacccaccgaaacgaaccccagcaauggguccucccgagcuacagugggagagacgugcacaauguucaucuggccccugcuguggcgccaacauuucccggcgagcaguuacuguucuuuaggucuaccaugccuggauguuccggcuaucccaacauggaucucgacugccuucugccacaggaguggguacagcacuucuaccaagaagcagccccugcucagagcgaugucgccuugcuacgguuugugaaucccgacacugggcguguucuguucgaguguaaacuccauaagucgggauaugugacggucgcacacacaggucagcacgaucuggugauaccaccgaacggcuacuuucgcuucgacucuuggguaaaccaguucuauacccuugccccuauggggaauggaacuggcagaaggcgggcucuguga

SEQ ID NO: 17939 - RNA, 1623 nt, Artificial Sequence
  derived and/or modified sequence opt3 from capsid_protein_VP1__Norovirus__AII02836
augaagauggccagcaacgacgcuaaucccuccgauggcucugcagccaaccuggugccugaggucucaaaugaaguuauggcgcucgagccaguggcuggggccgcaaucgccgcuccgguagcaggacagcaaaacgugauugaccccuggauaagaaauaacuucguccaggccccugguggcgaauuuaccgugaguccaaggaaugcucccggggagauccuuuggagcgccccucugggaccagauuugaaccccuacuuaucccaccuggcgcggauguauaauggcuacgccgguggguucgaaguucaggugauucuagcaggaaacgcuuuuacagccggcaaaaucauuuucgcagcugucccuccaaauuuuccgacugagggccucucucccucacaggugacgauguucccucauaucauaguagacguucgccaacuggagccagugcuuaucccccugccugauguccgaaacaauuuuuaucacuacaaccagaccaaugacucgacaauuaaguugaucgccaugcucuauacuccacugcgugcgaacaacgccggggaagauguguucaccgugagcugcagaguccugacaaggcccaguccggacuuugauuucauuuuucucguuccucccaccguggagucccggacuaaaccauucacaguaccuaucuuaaccguggaagagaugacuaauucucgcuuucccauaccacuggagaaacuuuucacgggacccagcggugcauucgucgugcagccucagaacggcagauguaccacagacgggguuuugcugggaacuacccaacuauccccagugaauauuugcacauuuaggggcgaugucacccauaucgcugguucacggaacuacacgaugaaucucgccagucugaacuggaauaacuaugacccgacugaagagauucccgcuccucuugggacaccagauuucgugggaaagauccagggcguacugacccagacuacaaagggcgacgggagcacccgcggacacaaggccacgguuuacaccgguucugcacccuuuacaccuaaauugggcuccgugcaguucucaacugacaccgaaaaugauuuugagacacaucaaaacacuaaguucaccccagucggggugauccaggacggaggcacaacccaccgaaaugaaccccagcaauggguccucccgagcuacagugguagagaugugcacaacguucaucuggccccugcuguggcgccaacuuuucccggggagcaguuacuguucuuuaggucuacgaugccuggcuguuccggauaucccaauauggaccucgauugccuucugccacaggaguggguacagcacuucuaccaagaagcagccccugcucagagcgacgucgccuugcuacgguuugugaaccccgauacaggccguguucuguucgaguguaaacuccauaagucgggguaugugaccgucgcacacacuggacagcacgaccuggugauuccaccgaaugguuacuuucgcuucgauucuuggguaaaccaguucuauacccuugccccuaugggcaacgggacaggaagaaggcgggcucuguga

SEQ ID NO: 17940 - RNA, 1623 nt, Artificial Sequence; identical to SEQ ID NO: 17729
  derived and/or modified sequence opt3 from capsid_protein_VP1__Norovirus__AII02839

SEQ ID NO: 17941 - RNA, 1623 nt, Artificial Sequence; identical to SEQ ID NO: 17737
  derived and/or modified sequence opt3 from capsid_protein_VP1__Norovirus__AII02842

SEQ ID NO: 17942 - RNA, 1647 nt, Artificial Sequence; identical to SEQ ID NO: 17873
  derived and/or modified sequence opt3 from capsid_protein_VP1__Norovirus__AII02845

SEQ ID NO: 17943 - RNA, 1647 nt, Artificial Sequence; identical to SEQ ID NO: 17873
  derived and/or modified sequence opt3 from capsid_protein_VP1__Norovirus__AII02848

SEQ ID NO: 17944 - RNA, 1623 nt, Artificial Sequence; identical to SEQ ID NO: 17688
  derived and/or modified sequence opt3 from capsid_protein_VP1__Norovirus__AII02851

SEQ ID NO: 17945 - RNA, 1623 nt, Artificial Sequence; identical to SEQ ID NO: 17655
  derived and/or modified sequence opt3 from capsid_protein_VP1__Norovirus__AII02854

SEQ ID NO: 17946 - RNA, 1623 nt, Artificial Sequence
  derived and/or modified sequence opt3 from capsid_protein_VP1__Norovirus__AII02857
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucauugugcagccucagaauggcagauguacuaccgacgggguuuugcugggaacaacucaacuauccccagugaacaucugcaccuuuaggggcgaugucacacauauugcagguucacggaauuacaccaugaaccucgcuagucugaauuggaacaauuaugacccgacggaagagauccccgccccucuugggacuccagauuucgugggaaagauccagggcguacugacacagaccacuaagggcgacgggagcacacgcggacacaaggcuaccguuuacacggguucugcccccuuuaccccuaaauugggcuccgugcaguucucaacagacacugaaaacgauuuugaggcacaucaaaauaccaaguucacaccagucggggugauucaggacggaggcacuacccaccgaaacgaaccccagcaauggguccucccgagcuacagugguagagaugugcacaauguucaucuggccccugcuguggcgccaacauuucccggggagcaguuacuguucuuuaggucuaccaugccuggcuguuccggauaucccaacauggaccucgauugccuucugccacaggaguggguacagcacuucuaccaagaagcagccccugcucagagcgacgucgccuugcuacgguuugugaaucccgauacuggccguguucuguucgaguguaaacuccauaagccaggguaugugacggucgcacacacaggacagcacgaccuggugauaccgccuaacgguuacuuucgcuucgauucguggguaaaccaguucuauacccuugcccccaugggcaaugggacuggaagaaggcgggcucuguga

SEQ ID NO: 17947 - RNA, 1623 nt, Artificial Sequence; identical to SEQ ID NO: 17655
  derived and/or modified sequence opt3 from capsid_protein_VP1__Norovirus__AII02860

SEQ ID NO: 17948 - RNA, 1623 nt, Artificial Sequence; identical to SEQ ID NO: 17655
  derived and/or modified sequence opt3 from capsid_protein_VP1__Norovirus__AII02866

SEQ ID NO: 17949 - RNA, 1623 nt, Artificial Sequence
  derived and/or modified sequence opt3 from capsid_protein_VP1__Norovirus__AII02869
augaagauggccagcaacgacgcuaaucccaccgauggcuccgcagccaaccuggugccugaggucucuaaugaaguuauggcgcucgagccagugguaggggcugccaucgcagccccgguggcuggacagcaaaacgucauugaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaaaucauuuucgccgcagugccuccaaauuuuccgacggagggccucucccccucucagguaaccauguucccucauaucauaguugacgugcgccaacuggagccaguccuuaucccccugccugaugugcgaaacaauuuuuaucacuacaaccagacaaaugacucgacuauuaaguugaucgcuaugcucuauaccccacugcgugccaacaacgcgggggaagauguguucacagucucaugcagaguucugaccaggcccagcccggacuuugauuucauuuuucucgugccucccacuguagagagucggacaaaaccauucaccgugccuaucuuaacggucgaagagaugacuaauucccgcuuucccauaccacuggagaaacuuuucaccggacccucuggugccuucgugguucagccucagaacggcagauguacaacugacgggguguugcugggaaccacacaacuaagcccagucaauauuugcaccuuuaggggcgaugugacgcauaucgcagguucccggaacuacacuaugaaucucgcuucacugaacuggaauaacuaugacccgacagaagagauucccgccccucuugggaccccagauuucguaggaaagauccagggcguucugacucagacaaccaagggcgacgggaguacgcgcggacacaaggcuaccguguacacagguagcgcccccuuuacuccuaaauugggcucuguccaguucuccaccgacacagaaaaugauuuugagacucaucaaaacaccaaguucacaccagugggggucauccaggacggaggcaccacucaccgaaaugaaccccagcaaugggugcucccgucauacagcgguagagauguucacaacgugcaucuggccccugcaguagcuccaacguuucccggggagcaguuacuguucuuuaggaguacaaugccuggcuguucuggauaucccaauauggaccucgauugccuucugccacaggaguggguccagcacuucuaccaagaagcggccccugcacaguccgacguggcuuugcuacgguuuguuaaccccgauaccggccgugugcuguucgaguguaaacuccauaagagcggguaugucacuguggcccacaccggacagcacgaccugguaauuccaccgaaugguuacuuucgcuucgauucgugggugaaccaguucuauacacuugcaccuaugggcaacgggaccggaagaaggcgggcccuguga

SEQ ID NO: 17950 - RNA, 1623 nt, Artificial Sequence; identical to SEQ ID NO: 17655
  derived and/or modified sequence opt3 from capsid_protein_VP1__Norovirus__AII02872

SEQ ID NO: 17951 - RNA, 1623 nt, Artificial Sequence; identical to SEQ ID NO: 17655
  derived and/or modified sequence opt3 from capsid_protein_VP1__Norovirus__AII02875

SEQ ID NO: 17952 - RNA, 1647 nt, Artificial Sequence; identical to SEQ ID NO: 17873
  derived and/or modified sequence opt3 from capsid_protein_VP1__Norovirus__AII02878

SEQ ID NO: 17953 - RNA, 1623 nt, Artificial Sequence; identical to SEQ ID NO: 17655
  derived and/or modified sequence opt3 from capsid_protein_VP1__Norovirus__AII02881

SEQ ID NO: 17954 - RNA, 1623 nt, Artificial Sequence; identical to SEQ ID NO: 17655
  derived and/or modified sequence opt3 from capsid_protein_VP1__Norovirus__AII02884

SEQ ID NO: 17955 - RNA, 1647 nt, Artificial Sequence; identical to SEQ ID NO: 17873
  derived and/or modified sequence opt3 from capsid_protein_VP1__Norovirus__AII02887

SEQ ID NO: 17956 - RNA, 1623 nt, Artificial Sequence; identical to SEQ ID NO: 17737
  derived and/or modified sequence opt3 from capsid_protein_VP1__Norovirus__AII02890

SEQ ID NO: 17957 - RNA, 1623 nt, Artificial Sequence; identical to SEQ ID NO: 17690
  derived and/or modified sequence opt3 from capsid_protein_VP1__Norovirus__AII02893

SEQ ID NO: 17958 - RNA, 1623 nt, Artificial Sequence
  derived and/or modified sequence opt3 from capsid_protein_VP1__Norovirus__AII02896
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcgcgucauucuagcaggaaacgccuuuacagcuggcaaaaucauuuucgccgcagugccuccaaauuuuccgacugagggccucucucccucgcagguaacgauguucccucauaucauaguugacgugcgacagcuggagccaguccuuaucccccugccugaugugcguaacaauuuuuaucacuacaaccaaaccaaugacucaacaauuaaguugaucgcuaugcucuauacuccacugagagccaacaacgcgggggaagauguguucaccgucagcugcaggguucugacacggcccaguccggacuuugauuucauuuuucucgugccucccaccguagagucccgcacuaaaccauucacagugccuaucuuaaccgucgaagagaugacuaauucuagauuucccauaccacuggagaaacuuuucacgggacccagcggugccuucgugguucagccucagaacgggagguguaccacagacggcguguugcugggaacuacccagcuauccccagucaauauuugcacauuucggggcgaugugacccauaucgcagguucacgcaacuacacgaugaaucucgcuagucugaacuggaauaacuaugacccgacugaagagauucccgccccucuugggacaccagauuucguaggaaagauccaaggcguucugacccagacuacaaagggcgacgggagcacccgaggacacaaggcuacgguguacaccgguucugcccccuuuacaccuaaauugggcuccguccaguucucaacugacaccgaaaaugauuuugagauccaucagaacacaaaguucacuccagugggggucauucaagacggaggcaccacacacagaaaugaaccccagcagugggugcucccgagcuacagugguagggauguucacaacgugcaucuggccccugcaguagcuccaaccuuucccggggagcaauuacuguucuuucggucuacuaugccuggcuguuccggauaucccaauauggaccucgauugccuucugccacaggaguggguccagcacuucuaccaggaagcggccccugcacaaagcgacguggcuuugcuacguuuuguuaaccccgauacgggccgcgugcuguucgaguguaaacuccauagaucgggguaugucacaguggcccacaccggacagcacgaccugguaauaccaccgaaugguuacuuuagguucgauucuugggugaaccaguucuauacucuugcaccuaugggcaacgggaccggacggcgacgcgcccuguga

SEQ ID NO: 17959 - RNA, 1647 nt, Artificial Sequence
  derived and/or modified sequence opt3 from capsid_protein_VP1__Norovirus__AII02899
augaagauggccagcaacgacgcugcacccuccaaugauggcgccgcggggcuggugccugagaucaacucugaagcuauggcccucgagccagucgcaggagccgcuauugcagccccgcuuaccggucagcaaaauauaaucgaccccuggauuaugaacaauuucguucaggcuccuggcggggaauuuacagugucaccaagaaacagucccggagagguacuguugaauuuagaacugggcccugagaucaacccauaccuagcccaccucgcgaggauguauaaugguuacgcagggggauucgaggugcaggucgugcuggccggcaacgcuuuuacugccggcaaaauuaucuucgcagcuauacccccuaauuuuccaaucgauaaccuuagcgccgcgcagauuacgaugugcccgcauguuaucguggacguccggcaacuggaacccgugaauuugccuaugccagauguacgcaacaauuucuuucacuauaaccagggguccgacucucgacuccgucugauugccaugcuguacacaccccucagagcaaacaauucgggagaugacguuuucaccgugucauguagggucuuaacucggccuagcccagauuuuaguuucaacuuucuggugcccccgaccguggaguccaagacaaaaccuuucucucuucccaucuugaccauaagcgaaauguccaauucacgcuuuccagucccuauugacagucugcauacuagccccacagagaacaucguugugcagugccagaaugguagaguaacccuagauggcgagcucauggggacgacucaacugcuuccaucucagauuugugcuuucaggggaaugcugacccgguccacaucacgcgccagcgaccaggcugauacugccacaccccgauuguucaacuauuacuggcacauccagcucgacaaucugaacggcaccccuuaugacccagcagaagauaucccgggucccuuagggaccccugacuuuagaggaaagguguucggcgucgccagucaaaggaauccagaugcuacgacucgggcgcaugaggcaaaaauugacacaaccucuggccguuuuacucccaagcuggggucccucgaaauaagcacagagucgggagauuucgaccagucucagccuacccgcuuuacgccaguggguaucggcguugaucacgaagccgacuuccaacaguggacccuucccgauuacgcugggcaguuuacacacaacaugaaucuggccccggcaguggccccuaacuucccaggagagcaguugcuauuuuucagaucccaacugcccucaaguggcgguaggagcaaugggauucucgacugccuggucccucaggagugggugcagcauuuuuaccaggaauccgcucccucucaaacucagguagcccuuguucgguaugugaacccagauaccggccgaguccuguucgaggcaaaguugcacaaacucggauuuaugacaaucgcuaagagcggcgacucaccuauaacugugcccccaaauggguacuuccgcuucgaaaguugggucaacccguuuuauacccuggcgccuaugggaacagguaacggcagaaggcggauucaguga

SEQ ID NO: 17960 - RNA, 1623 nt, Artificial Sequence; identical to SEQ ID NO: 17655
  derived and/or modified sequence opt3 from capsid_protein_VP1__Norovirus__AII02902

SEQ ID NO: 17961 - RNA, 1647 nt, Artificial Sequence
  derived and/or modified sequence opt3 from capsid_protein_VP1__Norovirus__AIS24557
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaacggacaaucuuagugccgcgcagaucaccaugugcccgcaugugaucgucgaugugcggcaacuggagcccauuaacuugccuaugccagacguacgcaauaacuucuuucacuauaaccaggggagcgauucccgacuccgucugaucgccaugcuguacacaccccucagagcaaauaacucuggagacgauguuuucacugugucguguagggucuuaacccggccuucaccagacuuuagcuucaauuuucuggugcccccgacaguggaaaguaagaccaaaccuuucacucuucccauuuugacaaucuccgagaugucuaacagccgcuuuccagucccuauagauucccugcauaccucacccacggacaauauuguugugcagugccagaacgguagaguaacucuagauggcgaacucauggggaccacacaacugcuuccaagucagaucugugcuuucaggggagugcugacucggagcaccucucgcgccuccgaccaggcugacgccgcaacaccccgauuguucaauuauuacuggcacauucagcucgauaaccugaauggcaccccuuaugacccagccgaggauaucccggcucccuuagguacgccugacuuuagagggaaggucuucggaguggcgucacaaaggaacccagauagcacuacacgggcacaugaggccaaaguugacaccacaaguggccguuuuacucccaagcugggcucucucgaaaucuccaccgagagcggggauuucgaccagaaucagccuacgcgcuuuaccccagugggaauuggugucgauaacgaagcugacuuccaacaguggacacuucccgauuacucgggccaguuuacucacaauaugaaccuggccccggcaguggccccuaauuucccaggggagcaguugcuauuuuucagaucucaacugcccuccucaggaggcaggaguaacgguauacucgacugccugguaccucaggaauggguucagcacuuuuaccaggagagcgcucccgcccaaacccagguggcacuuguccgguaugugaacccagacacagggcgaguccuguucgaggcgaaguugcauaaacucggcuacaugacuaucgcuaaguccggagauucuccuauuaccgugcccccaaauggcuauuuucgcuucgaaagcuggguuaacccguucuacacacuggccccuauggggaccggaaaugguagaaggcggauccaguga

SEQ ID NO: 17962 - RNA, 1620 nt, Artificial Sequence
  derived and/or modified sequence opt3 from capsid_protein_VP1__Norovirus__AIY30135
augagaaugagcgacggcgccgcucccaaggcagauggguccgaggccucuggacaggaccuggugccuaccgcggucgaacaagcuguuccaauccagccgguggccggugcagcccucgcugcacccgccgcuggccagauuaaccagauagauccuuggaucuuccaaaauuuuguacagugcccacuuggggaguucucaauuagucccaggaacacaccuggagaaauccuguuugacuuggccuuaggcccaggucugaaucccuaccuagcgcaccucagcgcaauguauacugggugggugggaaacauggagguccagcuggugcuugccggcaaugcuuucacggccggcaaaguuguggucgcacuggugccuccauacuuuccgaagggguccuugaccacagcucagauuacuuguuucccccauguaaugugcgauguucggacccucgaaccuauccaacugccacugcucgacgugcgccgagucuuauggcacgccacacaggaucaggaggagucuaugcgucugguguguaugcuuuauacccccuugagaacuaacucgccuggagacgaaucauuuguggucagcgguaggcugcuaaguaaaccagcggccgauuucaauuuuguuuaccucacacccccgauagagcggaccaucuaucgcaugguggaccugccuguaauucagcccagacuuugcacgcaugcaagguggccagcuccuguguacggccuguuggucgaucccucccucccaucuaacccccaauggcagaaugggcgggugcacguugacggaacucuguuaggcaccacaccugugagcgguuccugggucucauguuucgccgcugaagccgcauaugaguuucagagugggacuggacaaguggccaccuucacacugaucgagcaggauggcagcgcuuacguaccaggcgaccgcgcggcaccgcucggguaccccgacuuuucuggacagcuugaaauugagguucagaccgaaacgacuaagacaggugauaaacugaaggugaccacuuucgagaugaucuugggcccuacaaccaacgucgaccaagccccauaucaggggaagguguucgcuuccauaacggccgcagccucacuagaucuggucgacggacgagugagagcuguucccaggagcauuuacggcuuucaggaugugaucccugaauauaaugacggucuccugguaccacuugcacccccgauugggccuuuccugccaggcgaggucuugcuccgguuucguaccuacaugcgccagcuggauacagccgacgcggcugccgaggcaaucgauugcgccuuaccccaagaauuuaucaguugguuugcuucuaacguguucacuguucaguccgaggcccugcuacucagauauaggaauacccugacaggacagcuuuuguuugaauguaaacuguacagcgagggcuauauugcacucucguacucuggguccggaccucugacuuuccccaccgacgguuucuucgaaguggucucaugggugccacggcuuuaccagcuggcuaguguaggcagcuuggccacagggcgaacccucuga

SEQ ID NO: 17963 - RNA, 1623 nt, Artificial Sequence
  derived and/or modified sequence opt3 from capsid_protein_VP1__Norovirus__AKE07100
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaaucaguccaaggaaugcacccggggagauucuuuggagcgccccucugggaccagauuugaaccccuacuuaucccaccuggcucggauguauaauggcuacgccgguggguucgaaguucaggugauccuagcgggaaacgcauuuacugccggcaaagucauuuucgcugccgugccuccaaauuuuccgacggagggccucucucccucgcagguaaccauguucccucauaucguuguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuauucccgucuuaacaaucgaggaaaugaccaauagccgcuuuccaauaccccuggagaaacuuuucacgggaccuuccucagcguucgugguucagccacagaacgguagauguaguacugauggcguguugcuggggaccacacaacuaagcccggucaauauuugcacuuuuaggggagacgugacccauaucgccggcucucacaacuacacaaugaaucucgcaucccagaacuggaacucauaugaucccaccgaggaaauuccugcuccacuggguacgcccgacuucguagggaagauccagggaguucuuacucagacaacccgggccgacggcagcacucgcggccauaaggcuacagugcugaccgggagugccaauuuuacgccuaaguugggacgaauccaauucgcaaccgauacagacaaugauuuugagacuaaccagaauaccaaauucacaccagucggugugauucaggacggcgauacugcccacagaaacgaaccccaacaguggguccucccgucuuacuccgggaggaauacccacaacgugcaucuggcuccugcgguugcaccaacauuucccggagagcaguuacuguucuuucggagcaccauaccuggcuguucggguuaccccaauauggaccucgauugccuucugccacaggaaugggugcaauucuuuuaucaggaggccgcuccugcccagucugacguagcauugcuacguuucgucaaccccgauacugggcgcgugcuguuugaguguaagcuccacaaauccggcuacaucacgguugcccauacaggacagcacgaccuggugauuccaccgaacggcuauuucagauucgauucaugggucaaucaauuuuacacccuugcuccuauggggaacggaacugguaggcggcgagcccuguga

SEQ ID NO: 17964 - RNA, 1623 nt, Artificial Sequence
  derived and/or modified sequence opt3 from capsid_protein_VP1__Norovirus__AKE07103
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagucucucucgcccucacagguaacgauguucccucauaucauaguugacgugcgccaacuggagccaguccuuaucccccugccugaugugcgaaacaauuuuuaucacuacaaccagagcaaugacccaaccauuaaguugaucgcuaugcucuauacaccccugcgugccaacaacgcgggcgaugacguguucacugucaguugcagaguucugaccaggccguccccugauuuugacuucauuuuucucgugcccccaacaguagaaucucggaccaaaccuuucagcgugcccaucuuaacugucgaggaaaugacaaauucccgcuuuccaauaccccuggagaaacuuuucaccgggccuucaagugccuucgugguucagccacagaacggaagauguacgauugaugguguguugcugggcacuacccaacuaagcccggucaauaucugcacauuuaggggagacgugacucauauugcagggacccacaacuacacaaugaaucucgcuacccagaacuggaacucuuaugaucccacggaggaaaucccugccccacugggcacucccgacuucguagguaagauccaggggguucuuacacagaccacuaagacagacggauccacccggggccauaaggcuacgguguguauuggcucagccgauuuugcaccuaaacuggggcgcguccaauucgagaccgacacaaauaaugauuuggaaacuaaccagaauaccaaguuuacaccagugggagucauacagaacggugagacugcccaccgaaaugaaccccaacagugggugcucccgagcuacaguggcagaaacaccccuaauguucaccuggcuccagcgguggcacccacauucccuggggagcaguuacuguuuuucaggucuaccaugcccggaugcuccggcuacccaaacauggaccucgauugucuucugccucaggaguggguacaauauuuuuaccaggaagccgcucccgcccagagcgacgucgcauugcuacgguucgugaacccagauacuggucguguucuguuugagugcaaacuccauaagucgggguaugugacggucgcccacacaggcucucaugaccuggugaucccgccuaauggauacuuccgcuuugauuccuggguaaaccaguucuauacccuugcucccaugggcaaugggacuggaagaaggcgggccaccuga

SEQ ID NO: 17965 - RNA, 1623 nt, Artificial Sequence
  derived and/or modified sequence opt3 from capsid_protein_VP1__Norovirus__AKE07106
augaagauggccagcuccgacgcuaaccccucugauggcucaaccgcaaaucuggugccugaggucaacgacgaaguuauggcccucgagccagugguaggggcggcucuugccgcaccgguggccggacagcaaaaugucaucgaucccuggauuagaaacaauuucgugcaggcuccugguggcgaauuuacaguuaguccaaggaacgcacccggggagauacuguggagcgccccuuugggaccagacuuaaaucccuaccugucccaccuagcucggauguauaacggcuacgccgguggguucgaagugcaggucauccucgcgggaaaugcauuuacugccggcaaagugauuuucgcugccguaccuccaaacuuuccgacggagggccugucucccucgcagguuaccauguucccucauaucauuguggauguccgccaacuugagccagugcugauccccuugccugacgcacgaaauaacuuuuaucacuacaaucagucaaacgaaagcacaauaaagcucaucgcuaugcuguauacuccacugcgugccaauaacgcgggggaugacguguucaccgucaguugcagaguucucacaaggcccuccuuagauuuugacuucauuuuucuggugccgccuaccguagagucucggacuaaacccuucagcgugccaauccuuacagucgaagagaugaccaacucccgcuuuccuauucccuuggagagacuguucacgggaccaucaagugccuucgcagugcagccccagaaugguagguguacuaccgauggcguucuacucgggacaacucaacugagcccugugaacaucugcaccuuucggggagacgucacacauaccacgggcucucacaauuacacuaugaaccuugcuucccagaaucgcucaaacuaugauccaacagaagagauaccggcuccccuggguaccccugacuucguggggaagauucagggagccuugacucagacaacccgagccgacggcagcacgagaggccauaaagcaaccguauacacagggagugccgauuuuacuccaaagcucggaaggguucaauucgcuaccgacacagaucacgacuuugauacuaaucagaacaccaaguucacacccgugggugucauccaggacggcucuaccacucaccggaaugaaccucaacagugggugcugccauccuacagcgggcguaacacgcauaauguccacuuagcgcccgcaguggccccgacauuuccuggagagcagcuccuguucuuucgcucgaccaugccaggcuguucugguuaucccaacauggaucuugacugccuguugccucaggaauggguugcucauuucuaccaagaggccgcacccgcccaguccgauguggcucuacugagauuuguaaauccagacacugggaggguccucuucgaguguaaacugcacaagucaggcuaugugaccguugcccacacaggacagcaugaucuugugauuccucccaacggcuacuuucgguucgacaguugggucaaucaguucuauacccuggcaccaauggggaacggaacuggucgacgcagagcguuguga

SEQ ID NO: 17966 - RNA, 1719 nt, Artificial Sequence
  derived and/or modified sequence opt3 from capsid_protein_VP1__Norovirus__ALQ12260
augaagauggccagcaacggcgcugcagcccccucccaggacggggcggcuaaucuggugccugaaucucaacaggaaguccucgcccuugagccaguugcaggagccgcucuggcagccccgguggcuggucaguucaacgccaucgaucccuggauuaaacagaauuuuguacaagcgccugcaggcgaguucaccgugucaccaagaaacgcccccggggaagucuugauggacuuagaacugggaccugagaugaauccauuucuagcucaccucgcccagauguacaacgcauaugcuggcgguauggaggugcagauaauccuggccgggaaugcguucacagccggaaagauuaucguuugcgcagugcccccuaacuuuccaccggauaggcuuagugcuagccaggccacuaauuucccccaugucauuauggacgugcggacgcuggaaccuguaguuuugccacuccccgaugugcgcgcuggcuuuuuccacuacaaccaacugcgagagccucguaugagacugaugacccucuuauauacaccacugagggccaauggcacuggggacgaugcauuuaccgucuccugucgggugcuuacacgccccauguuggacuucgaauuuauguuccuggugccgccuaccgucgagucuagaguuacucccuuuucggugccaacauacccuguaguggagaugaccaacucaagguggcccgcccggaucagcggaaugcaugucaaugcuaaccagacgcuagcggugcaguuccagaauggucgcugcacucucgauggccaacugauggggaccacacagcuuugugcagccgacguuugccgaaugagaggaagguauacuagcacccgggcugauccagccggccuggguugggacuuggaugcaacaacccucguggacgggcccgaagcccguguccaggcucgcauauccgugucugcccaucugcaauuagaggaacugagcggacagccuuacgagguauauggcgaacagccagcaccgcucggcacgcccgacuuccaguguagacuuaugggggagcugguuagguugccuuccgcgaacccaguggcucaaucacgguuucgagaugccuucuuugacacuuacggagcacuauucgcccccgcugucgguagugugacagucaccgugaacaauaguucuuccucagauuuugccaacgaccagccuuucgaguuucugccaaucggcguugaaauugggaauagcgcacgcuacgaugaguucgcucuccccaguuauaacggagccaucggcgaaaauagacaccuggcgccgauugccgcuccugguuuuccaggggagaaccuuaucuucuuuucuuccaaucugcccgugugggacagcacuucggcacagucuaacaggcggauauccugcuugcucccuaaugaguucauucagcacuuuuacgaucugcaagcccccucacagagugacguagcuuuacugcgcuauguccacccagaaacagauagauuccuauucgaguguaaacucuacagggacgccuuucugaccgugaacggcgcaagcuaugcggaguucccuguuaauggauacucccguuuugauucuugggugaagcaguucuuuacgcuuagccccgucggcaccgggucaggacggcgagguagaaguaggaaagcccaguga

SEQ ID NO: 17967 - RNA, 1620 nt, Artificial Sequence
  derived and/or modified sequence opt3 from capsid_protein_VP1__Norovirus__BAI49904
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaagagccgcuuucccauaccacuggagaaacuuuacacgggacccuccucagcguucgugguucagccucagaacgguagauguacuaccgauggcguguugcuggggacaacucaacuaagugucgugaauauuugcaccuucaggggagacguaacacauaucgccggcagccacgauuauaccaugaaccucgcaucucagaauuggaacaauuacgacccaacggaggaaauuccggcuccccuggguacuccugacuuuguugggaagauccagggaaugcuuacacagaccacucgggaggauggcuccacacgcgcccauaaggcuaccgugucaacgggcagcguccacuucaccccaaaacuggggagugugcaauacacaacugacaccaacaaugauuuucagacaggacagaacacuaaguucacccccgucggugugauccaagacggcaauaaccaccagaaugaaccucagcaguggguuuugccaaacuauucugggcgaacaggacauaaugugcaccucgcccccgcaguagccccgaccuuuccuggcgagcaacuguuauucuuuagauccacuaugccagguuguagcggguaccccaacaugaaccuggauugccuccuuccucaggaauggguccagcauuucuaucaggaggcugcgcccgcacaaucggacguggcccuguugagguuuguuaauccagauacgggccgguuccuauuugaguguaaacugcacaagucuggauacgugacagucgcucacaccggcccucaugaccucgugauucccccaaacggguauuuccguuuugauuccuggguaaaucaguucuacacucuggccccgaugggaaacggugcaggccgcagaagggugcuuuga

SEQ ID NO: 17968 - RNA, 1623 nt, Artificial Sequence
  derived and/or modified sequence opt3 from capsid_protein_VP1__Norovirus__BAI49905
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgagcacgcggacuuaccgcaugaaccucgccucucagaauuggaacaauuaugaucccacagaggaaauuccugcaccacugggcacccccgacuucguagguaagauccaggggaugcuuacucagacaaccaagggagacggcuccacgcgaggccacaaggcuaccguuucaacagggagcguggauuuuacuccuaaacugggaaguguccaauucgccaccgacacagauaacgacuuugagacuggucagaauaccagauucacaccagugggcgucauccaggaugggucuuccgcucauaggaacgaaccccaacaguggguguugccggacuacagcggacggaccguucacaaugugcaccucgccccugcaguagccccaacuuuucccggcgagcagcuguuauucuuucguucgacgaugccugguuguucuggguaccccaacauggaucuggacugccuccuuccacaggaauggguccaacauuucuaucaggaggcugcgccugcacaguccgauguggcccuguugcgcuuuguuaaucccgacacaggcagagugcuauucgaguguaagcugcacaaaaccggauacgucacuguggcucauaccggccagcacgaucucguaauuccaccgaacggguauuuuagguucgacucaugggugaaucaauucuacacacuggccccuaugggaaacggugcaggccggcgacgcgcccuuuga

SEQ ID NO: 17969 - RNA, 1623 nt, Artificial Sequence
  derived and/or modified sequence opt3 from capsid_protein_VP1__Norovirus__BAI49906
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcacgggcauaaggcuaccguuuccacaggaucaguggauuuuacuccuaaacuggguagcguccaauucgccaccgacacagauaacgacuuugagacuggccagaauacccgauucacaccagugggggucauccaggauggaaguucugcucacagaaacgaaccccaacaguggguguugccggacuacuccggcaggaccguucacaaugugcaucucgccccugcaguagccccaacuuuucccggugagcagcuguuauucuuucggagcacgaugccuggguguucgggcuaccccaacauggaucuggacugccuccuuccacaggaauggguccaacacuucuaucaggaggcugcgccugcacagucugauguggcccuguugcguuuuguuaaucccgacacaggacgcgugcuauucgaguguaagcugcauaaaaccggcuacgucacuguggcucacaccgggcagcacgaucucguaauuccaccgaacggauauuuuagauucgacuccugggugaaucaauucuacacacuggccccuauggguaacggcgcagggaggcggcgagcccuuuga

SEQ ID NO: 17970 - RNA, 1623 nt, Artificial Sequence
  derived and/or modified sequence opt3 from capsid_protein_VP1__Norovirus__BAI49907
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaguucuuacucagacaacccgaggcgacggcucuacgagagggcacaaggcuaccguguccacaggaucagucgauuuuacuccuaagcuggguagcgugcaauucgccaccgacacagauaacgacuuugagacuggccagaauaccagguucacaccagucggggugauccaggauggaaguucugcucaucggaacgaaccccaacaguggguuuugccggacuacuccggccguaccgugcacaauguacaccucgccccugcagucgccccaacuuuucccggugagcagcuguuauucuuucgcuucacgaugccuggguguagcggcuaccccaacauggaucuggacugccuccuuccacaggaaugggugcaacauuuuuaucaggaggcugcgccugcacagucggauguugcccuguugagauucgugaaucccgacacaggaaggguccuauuugaguguaaacugcacaagaccggcuacgugacuguagcucauaccgggcagcacgaucucgugauuccaccgaacggauauuuccgguucgacucuuggguuaaucaauuuuacacacuggccccuauggguaacggcgcagggcgacgcagagcccuuuga

SEQ ID NO: 17971 - RNA, 1623 nt, Artificial Sequence
  derived and/or modified sequence opt3 from capsid_protein_VP1__Norovirus__BAI49909
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacuguuucaccaaggaaugcacccggggagauccuuuggagugccccucugggaccagauuugaaccccuacuuaagccaccuggcucggacguauaauggcuacgccgguggguucgaagugcaggucauucuagcgggaaacgcauuuaccgccggcaaaaucauuuucgcugccgugccuccaaauuuuccgacagagggccucucccccucucagguaacuauguucccucauaucauaguugacgugcgccaacuggagccaguccuuaucccccugccugaugugcgaaacaauuuuuaucacuacaaccagucgaaugacucaaccauuaaguugaucgcaaugcucuauacaccacugcgugcuaacaacgccggggaugacguguucaccgucagcugcagaguucugacuaggcccaguccggauuuugacuucauuuuucucgugccucccacaguagaaucccggaccaaaccauucucugugccuaucuuaacggucgaggaaaugacuaauagccgcuuucccauaccacuggagaaacuuuucaccggacccuccucagcguucgugguucagccucagaacgguagauguacaacugauggcguguugcuggggaccacacaacuaaguccagucaauauuugcaccuuuaggggagacgugacgcauaucgccggcacucagaacuacacaaugaaucucgcaagccagaacuggaauaacuaugauccgaccgaggaaauucccgcuccucuggguacuccagacuucguagggaagauccagggaguucuuacacaaaccacgcggcgcgacggcucuacccgaggccacaaggccacaguguccacugggucaguccauuuuacccccaagcugggaagcgugcaguucaguacagauacuucuaaugacuuugagaccggucagaacacaagauucaccccugucggcgugguucaagauggguccacuacgcaccagaaugaaccacagcaguggguguugcccaacuacagcggaagggacucgcacaauguacaucucgcuccggccgucgcaccuacauuuccaggcgagcaacuguuauucuuucggucuaccaugcccgguuguuccggguacccuaacaugaaucuggauugccuccuuccccaggaaugggugcagcacuucuaucaggagucagccccagcucaaagugacguugcgcuguugcguuuugugaacccugauacuggccgcguccuauucgaguguaaacugcauaagagcggauacgugaccguagcacacacaggccagcacgaccucgugauucccccaaacggguauuuuagauucgauuccuggguuaaucaguucuacacccuggccccgaugggaaacggugcuggcaggcggcgagcccuuuga

SEQ ID NO: 17972 - RNA, 1623 nt, Artificial Sequence
  derived and/or modified sequence opt3 from capsid_protein_VP1__Norovirus__BAI49910
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacucaacuauuaaguugaucgcaaugcucuauaccccacugcgugcuaacaacgccggggaugacguguucacagucagcugcagaguucugaccaggcccaguccggauuuugacuucauuuuucucgugccucccacuguagaaucccggacaaaaccauucucugugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucgccggcacgcagaacuacacuaugaaucucgcaagccagaacuggaauaacuaugauccgacagaggaaauucccgcuccucuggguaccccagacuucguagggaagauccagggaguucuuacucaaacaacccggcgcgacggcucuacgcgaggccacaaggccaccguguccacagggucaguccauuuuacucccaagcugggaagcgugcaguucaguaccgauacaucuaaugacuuugagacuggucagaacaccagauucacaccugucggcgugguucaagauggguccaccacucaccagaaugaaccacagcaguggguguugcccaacuacagcggaagggacucgcacaauguacaucucgcuccggccgucgcaccuacguuuccaggcgagcaacuguuauucuuucggucuacaaugcccgguuguuccggguacccuaacaugaaucuggauugccuccuuccccaggaaugggugcagcacuucuaucaggagucagccccagcucaaagugacguugcgcuguugcguuuugugaacccugauaccggccgcguccuauucgagugugaacugcauaaaagcggauacgugacuguagcacacaccggccagcacgaccucgugauucccccaaacggguauuuuagauucgauuccuggguuaaucaguucuacacacuggccccgaugggaaacggugcuggcaggcggcgagcccuuuga

SEQ ID NO: 17973 - RNA, 1623 nt, Artificial Sequence
  derived and/or modified sequence opt3 from capsid_protein_VP1__Norovirus__BAI49911
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaacccgaggcgacggccugacgagagggcacaaggcuaccguuucuacaggauccguggauuuuacuccuaaguuggguucaguccaauucgccaccgacacagauaacgacuuugagacuggccagaauaccagguucacaccagugggggucauccaggauggaagcagugcucaucggaacgaaccccaacagugggugcucccggacuacucuggccguaccguucacaaugugcaccuggccccugcaguagccccaacuuuucccggugagcaguuacuguucuuucgcuccacgaugccuggguguagcggcuaccccaacauggaucucgacugccuucugccacaggaauggguccaacauuucuaucaggaggcugcgccugcacagucggauguggccuugcuaagauuuguugaccccgauacaggaagggugcuguucgaguguaaacuccacaagaccggcuacgucacuguggcucauaccgggcagcacgaccugguaauuccaccgaauggauauuuucgguucgacucuugggugaaccaauucuacacacuugccccuauggguaauggcgcagggcgacgcagagcccuguga

SEQ ID NO: 17974 - RNA, 1623 nt, Artificial Sequence
  derived and/or modified sequence opt3 from capsid_protein_VP1__Norovirus__BAI49912
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaagcuguucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggcgaauccagggaaugcuuacucagacaaccaaaggcgacggcucuacgagagggcacaaggcuaccguuuccacaggaucaguggauuuuacuccuaagcuggguagcguccaauucgccaccgacacagauaacgacuuugagacuggccagaauaccagguucacaccagugggggucauccaggauggaaguucugcuuugcggaacgaaccccaacagugggugcucccggacuacuccggccguaccguucauaaugugcaccuggccccugcaguagccuuaacuuuuccaggugagcagcuucucuucuuucgcagcacgaugcccggguguucgggcuacccuaacauggaucuugacugccuguugccccaggaauggguccaacacuucuaucaggaggcugcgccaucucaguccgauguggcacuacugagauuuguuaauccugacacaggaaggguccucuucgaguguaaacugcaucgggccggcuacgugaccguggcucacacugggcagcaugaucuuguaauucccccaaacggauauuuucgauucgacucaugggugaaucaauucuacacccuggccccgauggguaacggcgcagggcgcagaagggccuuguga

SEQ ID NO: 17975 - RNA, 1623 nt, Artificial Sequence
  derived and/or modified sequence opt3 from capsid_protein_VP1__Norovirus__BAI49914
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcgagggcacaaggcuaccguuuccacaggaucaguggauuuuacuccuaaacuggguagcguccaauucgccaccgacacagauaacgacuuugagacuggccagaauaccagauucacaccagugggggucauccaggauggaaguucuacccauaggaacgaaccccaacaguggguguugccggacuacuccggccggacuguucacaaugugcaccucgcuccugccguagcaccaacguuucccggugagcagcuguuauucuuucguagcacaaugccuggguguucgggcuaccccaacauggaucuggacugccuccuuccacaggaauggguccaacauuucuaucaggaggccgcuccuucucaguccgauguggcgcuguugcgcuuuguuaaucccgacaccggaagagugcuauucgaguguaagcugcacaaagcaggcuacgucacuguggcccauaccgggcagcacgaucucguaauuccaccgaacggauauuuuagguucgacucaugggugaaucaauucuacacacuggcuccuauggguaacggcgccgggcggcgacgcgcacuuuga

SEQ ID NO: 17976 - RNA, 1623 nt, Artificial Sequence
  derived and/or modified sequence opt3 from capsid_protein_VP1__Norovirus__BAI49916
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaaaauccagggccuguugacacagaccacuaagggcgacgggagcacacgcggacacaaggcuaccguuuacacggguucugcccccuuuaccccuaaacucggcggggugcaguucuccacagacacugaaaacgauuuugagacccaucaaaauacaaaguucacuccagucggagugauccaggacggcucaaccacacaccgaaacgaaccccagcaauggguccugccgagcuacagugguagaaaugugcacaacguucauuuagccccugcaguggcuccaaccuuucccggggagcagcuucucuucuuuaggucuacuaugccuggcuguuccggauaucccaauauggaucuugacugccuguugccacaggaguggguacagcacuucuaccaagaagcggccccugcacagagcgaugucgcucuacugcgguuugugaaccccgacacgggccguguucucuucgaguguaaacugcauaagucgggguaugugacagucgcccacaccggacagcacgaucuugugauuccaccgaacgguuacuuucgcuucgacucuuggguaaaucaguucuauacucuggcaccuaugggcaacgggaccggaagaaggcgggccuuguga

SEQ ID NO: 17977 - RNA, 1623 nt, Artificial Sequence
  derived and/or modified sequence opt3 from capsid_protein_VP1__Norovirus__BAI49917
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagaggugaccaacucucgcuuucccauaccacuggagaaacuuuucacgggacccagcggugccuucguugugcagccucagaauggcagauguacuaccgacggggucuugcugggaacaacucaacuauccccagugaacauuugcaccuuuaggggcgauguaacacauaucgcagguacccggaauuacacgaugaaccucgcuucacugaauuggaacaauuaugacccgacugaagagauucccgccccucuugggacaccagauuucguuggaaagauccagggcgugcugacccagacuacaaagggcgacgggaguacccgcggacacaaggcuacggucuacaccgguagcgcccccuuuacaccuaaauugggcucugugcaguucuccacugacaccgaaaacgauuuugagacacaucaaaauacuaaguucaccccagucggggugauccaggacggaggcacaacccaccgaaacgaaccccagcaauggguucucccgucauacagcgguagaaaugugcacaacguacaucuggccccugcagucgcuccaacuuuucccggggagcaguuacuguucuuuaggaguacgaugccuggcuguucuggauaucccaauauggaucucgacugccuucugccacaggagugggugcagcacuucuaccaagaagcggccccugcacaguccgauguugcuuugaugcgguuugugaaccccgacacaggccguguccuauucgaguguaaacugcauaagagcggguaugugaccguagcccacacuggacagcacgaucucgugauuccaccgaacgguuacuuucgcuucgacucguggguuaaucaguucuauacccuggcaccuaugggcaacgggacaggaagaaggcgggcccuuuga

SEQ ID NO: 17978 - RNA, 1623 nt, Artificial Sequence
  derived and/or modified sequence opt3 from capsid_protein_VP1__Norovirus__BAI49918
augaagauggccagcaacgacgcuaaucccuccgauggcucugcagccaaccuggugccugaggucaauaacgaaguuauggcgcucgagccaguggcuggggccgcaaucgccgcuccgguagcaggacagcaaaaugugauugaccccuggauaagaaacaauuucguccaggccccugguggcgaauuuaccgugucaccaaggaacgcucccggggagauccuuuggagugccccucugggaccagauuugaaucccuacuuaagccaccuggcgcggauguauaacggcuacgccgguggguucgaaguucaggugauucuagcaggaaaugcuuuuacagccggcaaaaucauuuucgcagcugucccuccaaacuuuccgacugagggccucucccccucucaggugacgauguucccucauaucauaguagacguucgccaacuggagccagugcuuaucccccugccugauguccgaaauaacuuuuaucacuacaaucagucgaacgacucaaccauuaaguugaucgccaugcucuauacaccacugcgugcgaacaaugccggggaagauguguucacugugagcugcagaguccugaccaggcccaguccggacuuugauuucauuuuucucguuccucccacaguggagucccggaccaaaccauucacuguaccuaucuuaacaguggaagagaugaccaacucucgcuuucccauaccacuggagaaacuuuucacgggacccagcggugcauucgucgugcagccucagaauggcagauguacuaccgacgggguuuugcugggaacaacucaacuauccccagugaacauuugcaccuuuaggggcgaugucacacauaucgcugguacccggaauuacacgaugaaccucgccucacugaauuggaacaauuaugacccgacugaagagauucccgcuccucuugggacaccagauuucgugggaaagauccagggcguacugacccagacuacaaagggcgacgggaguacccgcggacacaaggccacgguuuacaccgguagcgcacccuuuacaccuaaauugggcucugugcaguucuccacugacaccgaaaacgauuuugagacacaucaaaauacuaaguucaccccagucggggugauccaggacggaggcacaacccaccgaaacgaaccccagcaauggguccucccgucauacagcgguagaaaugugcacaacguucaucuggccccugcuguggcgccaacuuuucccggggagcaguuacuguucuuuaggaguacgaugccuggcuguucuggauaucccaauauggaucucgacugccuucugccacaggaguggguacagcacuucuaccaagaagcagccccugcucaguccgaugucgccuugaugcgguuugugaaccccgacacaggccguguucuauucgaguguaaacugcauaagagcggguaugugaccgucgcacacacuggacagcacgaucucgugauuccaccgaacgguuacuuucgcuucgacucguggguaaaucaguucuauacccuggccccuaugggcaacgggacaggaagaaggcgggcucuuuga

SEQ ID NO: 17979 - RNA, 1623 nt, Artificial Sequence
  derived and/or modified sequence opt3 from capsid_protein_VP1__Norovirus__BAI49919
augaagauggccagcaacgacgcuaaucccuccgauggcucugcagccaaccuggugccugaggucaauaacgaaguuauggcgcucgagccagugguaggggcugccaucgcagccccgguggcuggacagcaaaauauuauagaccccuggaucagaaacaauuucguccaggcaccugguggcgaauuuaccgugucaccaaggaacgcccccggggagauucuuuggagugcuccucugggaccagauuugaaucccuacuuaagccaccuggcccggauguauaacggcuacgcggguggguucgaaguucaggugauccuagcaggaaaugccuuuacagcuggcaaaauuaucuucgccgcagucccuccaaacuuuccgacugagggccucucccccucucaggugacgauguucccucauauaaucguagacguucgccaacuggagccagugcuuauuccccugccugauguccgaaauaacuuuuaucacuacaaucagucgaacgacucaaccaucaaguugauugcuaugcucuauacaccacugcgugccaacaaugcgggggaagauguguucacugugagcugcagaguccugaccaggcccaguccggacuuugauuucaucuuucucguuccucccacaguggagucccggaccaaaccauucacuguaccuauauuaacaguggaagagaugaccaacucucgcuuucccauuccacuggagaaacuuuucacgggacccagcggugccuucgucgugcagccucagaauggcagauguacuaccgacgggguuuugcugggaacaacucaacuauccccagugaacaucugcaccuuuaggggcgaugucacacauauugcagguacccggaauuacacgaugaaccucgcuucacugaauuggaacaauuaugacccgacugaagagauccccgccccucuugggacaccagauuucgugggaaagauccagggcguacugacccagacuacaaagggcgacgggaguacccgcggacacaaggcuacgguuuacaccgguagcgcccccuuuacaccuaaauugggcucugugcaguucuccacugacaccgaaaacgauuuugagacacaucaaaauacuaaguucaccccagucggggugauucaggacggaggcacaacccaccgaaacgaaccccagcaauggguccucccgucauacagcgguagaaaugugcacaacguucaucuggccccugcaguggcuccaacuuuucccggggagcaguuacuguucuuuaggaguacgaugccuggcuguucuggauaucccaauauggaucucgacugccuucugccacaggaguggguacagcacuucuaccaagaagcggccccugcacaguccgaugucgcuuugaugcgguuugugaaccccgacacaggccguguucuauucgaguguaaacugcauaagagcggguaugugaccgucgcccacacuggacagcacgaucucgugauaccaccgaacgguuacuuucgcuucgacucguggguaaaucaguucuauacccuggcaccuaugggcaacgggacaggaagaaggcgggcccuuuga

SEQ ID NO: 17980 - RNA, 1623 nt, Artificial Sequence
  derived and/or modified sequence opt3 from capsid_protein_VP1__Norovirus__BAI49920
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucaguugaacgacucgaccauuaagcucaucgcuaugcuguauacaccacugcgugccaacaaugcgggggaagauguguucacugucucaugcagaguucucaccaggcccagcccggacuuugauuucauuuuucuggugccucccacaguagagagucggaccaaaccauucacugugccuauccugacagucgaagagaugaccaacucccgcuuucccauaccacuugagaaguuguucacgggacccucuggugccuucgugguucagccucagaauggcagauguacuaccgacggggugcugcuaggaacaacucaacucagcccagucaacauuugcaccuuuaggggcgaugugacacauaucgcagguucccggaauuacaccaugaaccuggcuucacuuaauuggaacaauuaugacccgacggaagagauucccgccccucuggggacuccaggauucguaggcaaaauccagggcguuuugacacagaccacuaagggggauggaaguacacgcggucacaaggcuaccguguacacgggcagcgcccccuuuaccccuaaacucgggucuguccaguucuccacagacacugaaaacgacuuugagacccaucaaaauacaaaguucacuccagugggagucauccaggauggcucaaccacacaccgaaacgaaccccagcaaugggugcugccgagcuacagugguagaaauguucacaacgugcauuuagccccugcaguagcuccaaccuuucccggggagcaguuacucuucuuuaggucuacuaugccuggcuguuccggauaucccaauauggaccuugauugccuguugccacaggaguggguccagcacuucuaccaagaagcggccccugcacagagcgacguggcucuacugcgguuuguuaaccccgauacgggccguguccucuucgaguguaaacugcauaagucgggguaugugacaguggcccacaccggacagcacgaccuuguaauuccaccgaacgguuacuuucgcuucgauucuugggugaaucaguucuauacucuggcaccuaugggcaacgggaccggaagaaggcgggccuuguga

SEQ ID NO: 17981 - RNA, 1623 nt, Artificial Sequence
  derived and/or modified sequence opt3 from capsid_protein_VP1__Norovirus__BAI49921
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaaucgacguucgccaacuggagccagugcuuauuccccugccugauguccgaaacaauuuuuaucacuacaaccagucaaaugacagcaccaucaaguugauugcuaugcucuauacaccacugcgugccaacaacgcgggggaagauguguucacugugaguugcagaguccugaccaggcccucccucgacuuugauuucaucuuuuuaguuccgccuacaguggagucucggaccaaacccuucacuguaccaauacugacaguggaagagaugaccaauagccgcuuuccuauuccccuugagaaguuguucacgggaccauccggugccuucgucgugcagccccagaacggcagauguacuaccgacgggguucugcuaggaacaacucaacucucaccugugaauaucugcacccugaggggcgaugucacacauauugcagguagucggaacuacaccaugaaucuugcuagccugaacuggaauaacuaugacccaacggaagagaucccggcccccuuggggacuccugauuuugugggaaaaauccagggcguacucacacagaccacuaagggcgacgggucuacacgcggacacaaggcuaccguuuacacggguuccgccccauucacccccaaacugggcucagugcaguuuagcacagacacugaaaaugauuucgagacccaucaaaacacaaaguuuacuccugucggggugauucaggacggaaguaccacacaccgaaaugaaccacagcaaugggucuuacccucuuacuccggcagaaacgugcacaauguucaucuggcaccggccguggcuccuaccuucccaggugagcagcuccuguuuuucaggagcacuaugcccggguguucgggcuauccuaacauggaucuugacugcuugcuaccccaggaguggguacagcacuuuuaccaagaagcggcaccagcccagucugaugucgcucugcuccgguucgugaauccugacacgggacguguucuguuugaguguaaacuucauaaguccggcuaugugacagucgcccacaccgggcagcacgaucuggugauacccccaaacggauacuuccgcuuugacucauggguaaaccaguucuauacuuuggcaccgauggguaauggcaccgggagaaggcgggcccucuga

SEQ ID NO: 17982 - RNA, 1623 nt, Artificial Sequence
  derived and/or modified sequence opt3 from capsid_protein_VP1__Norovirus__BAI49923
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacggaauuacacgaugaaccucgcuagucugaauuggaacaauuaugacccgacugaagagauucccgccccucuugggacaccagauuucguaggaaagauccaaggcguucugacccagacuacaaagggcgacgggagcacccgcggacacaaggcuacgguguacaccgguucugcccccuuuacaccuaaauugggcuccguccaguucucaacugacaccgaaaacgauuuugagacacaucagaauacuaaguucaccccagugggggucauccaagacggaagcacaacccaccgaaacgaaccccagcagugggugcucccgaguuacucuggcagaaauguucacaacgugcaucuggccccugcaguagcuccaacuuuucccggugagcaauuacuguucuuuagguccacgaugccuggguguagcggcuaucccaauauggaucucgacugccuucugccacaggaguggguccagcacuucuaccaggaagcggccccugcacaaucggauguggcuuugcuacgguuuguuaaccccgacacaggacgugugcuguucgaguguaaacuccauaagucuggcuaugucaccguggcccacacugggcagcacgaucugguaauuccaccgaacggauacuuucgcuucgacuccugggugaaucaguucuauacccuugcaccuauggguaacggcacagggagaaggcgggcccuguga

SEQ ID NO: 17983 - RNA, 1623 nt, Artificial Sequence
  derived and/or modified sequence opt3 from capsid_protein_VP1__Norovirus__BAI49924
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacauuaugaaccucgcuagccugaauuggaacaauuaugacccgaccgaagagauccccgccccucuugguacgccagauuucguagggaagauccagggaguucugacucagacaaccaagggcgacggcucuacucgcgggcacaaggcuacaguguacaccggauccgcccccuuuacgccuaaauuggguucaguccaguucagcaccgacacagaaaacgauuuugagacucaucaaaauacccgauucacaccagugggcgucauucaggacgggggaacuacccacagaaacgaaccccagcaaugggugcucccgaguuacucuggcaggaauguuccuaacgugcaccuggcaccagccguagcucccacauuuccuggugagcaguuacuguucuuucgguccaccaugcccggguguagcggcuauccaaauauggaucucgacugccuucugccucaggaguggguccagcauuucuaccaagaagcggcacccgcccagucggauguggcuuugcuacguuuuguuaacccagacacuggacgcgugcuguucgaguguaagcuccacaaaucuggcuaugucacgguggcccauacagggcagcacgaucugguaauaccgccuaacggauacuuuagauucgacuccugggugaaucaguucuauacccuugcacccauggguaacggcacugggaggcggcgaguucuguga

SEQ ID NO: 17984 - RNA, 1623 nt, Artificial Sequence
  derived and/or modified sequence opt3 from capsid_protein_VP1__Norovirus__BAI49925
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggagugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacacgauucacuccagugggcgucauccaggacgggggaaccacacacagaaaugaaccccagcaaugggugcucccgucuuacuccggcaggaacguuccuaaugugcaccuggcaccagccguagcucccaccuuuccuggugagcaguuacuguucuuucggagcacuaugcccggguguucgggcuauccaaacauggaucucgacugccuucugccucaggaguggguccagcauuucuaccaagaagcggcacccgcccagucugauguggcuuugcuacguuuuguuaauccagacacgggacgcgugcuguucgaguguaagcuccacaaauccggcuaugucacaguggcccauaccgggcagcacgaucugguaauuccgccuaacggauacuuuagauucgacucaugggugaaccaguucuauacucuugcacccauggguaauggcaccgggaggcggcgaguucuguga

SEQ ID NO: 17985 - RNA, 1623 nt, Artificial Sequence
  derived and/or modified sequence opt3 from capsid_protein_VP1__Norovirus__BAI49926
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucacgagucugaauuggaacaauuaugacccgacugaagagauucccgcuccucuugggacaccagauuucguaggaaaaauccagggccuguugacccagacuacaaagggcgacgggagcacccgcggacacaaggccacgguuuacaccgguucugcucccuuuacaccuaaacucggcuccgugcaguucucaacugacaccgaaaacgauuuugagacacaucaaaauacuaaguucaccccagucggggugauccaggacggaagcacaacccaccgaaacgaaccccagcaauggguccugccgaguuacucuggcauuaaugugcacaacguucauuuagccccugcaguggccccaacuuuucccggugagcagcuucucuucuuuagauccacgaugccuggguguagcggcuaucccaauauggaucuugacugccuguugccacaggaguggguacagcacuucuaccaagaagcugcgccugcacagucggaugucgcccuacugagguuugugaaccccgacacaggacggguucucuucgaguguaaacugcauaagucuggcuaugugaccgucgcucacacugggcagcacgaucuugugauaccaccgaacggauacuuucguuucgacuccuggguaaaucaguucuauacccuggccccuauggguaacggcacagggcgcagaagggcauuguga

SEQ ID NO: 17986 - RNA, 1623 nt, Artificial Sequence
  derived and/or modified sequence opt3 from capsid_protein_VP1__Norovirus__BAI49927
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacggaauuacacgaugaaccucgcuagucugaauuggaacaauuaugacccgacugaagagauucccgccccucuugggacaccagauuucguaggaaagauccaaggcguucugacccagacuacaaagggcgacgggagcacccgcggacacaaggcuacgguguacaccgguucugcccccuuuacaccuaaauugggcuccguccaguucucaacugacaccgaaaacgauuuugagacacaucagaauacuaaguucaccccagugggggucauccaagacggaggcacaacccaccgaaacgaaccccagcagugggugcucccgagcuacagugguagaaauguucacaacgugcaucuggccccugcaguagcuccaacuuuucccggggagcaauuacuguucuuuaggucuacgaugccuggcuguuccggauaucccaauauggaucucgacugccuucugccacaggaguggguccagcacuucuaccaggaagcggccccugcacaaagcgauguggcuuugcuacgguuuguuaaccccgacacaggccgugugcuguucgaguguaaacuccauaagucgggguaugucaccguggcccacacuggacagcacgaucugguaauuccaccgaacgguuacuuucgcuucgacucuugggugaaucaguucuauacccuugcaccuaugggcaacgggacaggaagaaggcgggcccuguga

SEQ ID NO: 17987 - RNA, 1623 nt, Artificial Sequence
  derived and/or modified sequence opt3 from capsid_protein_VP1__Norovirus__BAI49928
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucugauaccccuugagaaguuguucacuggaccaagcggugccuucgugguucagccccagaauggcagauguaccacagacggggugcugcuaggaacuacccagcucuccccugucaacauuugcacauuuaggggcgaugugacccauaucgcagguucacggaauuacacgaugaaccuggcuagucuuaauuggaacaauuaugacccaacugaagagauuccggcuccccuggggacaccugauuucguaggaaaaauccaaggcguuuugacccagacuacaaagggcgacgggagcacccgcggacacaaggccacgguguacaccgguucugccccauuuacacccaaacucggcuccguccaguucucaacugacaccgaaaacgauuuugagacacaucagaauacuaaguucaccccugugggggucauccaagacggaagcacaacccaccgaaacgaaccacagcagugggugcugcccaguuacucuggcagaaauguucacaacgugcauuuagcaccggccguagcuccuacuuuuccaggugagcaacuccucuucuuuagguccacgaugcccggguguagcggcuauccuaauauggaucuugacugccuguugccccaggaguggguccagcacuucuaccaggaagcggcaccagcccaaucggauguggcucuacugcgguuuguuaacccugacacaggacgugugcuguucgaguguaaacugcauaagucuggcuaugucaccguggcccacacugggcagcacgaucuuguaauucccccaaacggauacuuucgcuucgacuccugggugaaucaguucuauacccuggcaccgauggguaacggcacagggagaaggcgggccuuguga

SEQ ID NO: 17988 - RNA, 1620 nt, Artificial Sequence
  derived and/or modified sequence opt3 from capsid_protein_VP1__Norovirus__BAJ25070
augaagauggccagcuccgacgcugcacccucuaacgauggcgccaccgggcuggugccugagaucaauacagaaacucucccacuugagccggucgcgggagcugccauugcagcccccguuacgggucagaacaauauaaucgacccuuggauuagaaacaauuucgugcaagcuccaaacggcgaauuuaccguaucacccaggaauaguccuggggagauccugaugaacuuggaauuaggaccagaucugaaucccuaccuagcacaccucagccggauguauaacggcuacgccggugggguggagguccaggugcugcuugcuggaaaugccuucacagcgggcaaaauucuguuugcagccguuccuccaaacuucccgguggacauguugucccccgcucagaucacuaugcucccucaucugauagucgaugugcgcacccuggagccaaucaugauuccccucccugacguacgaaauguguuuuaucacuacaacaaucagccagcaccccguaugagauuaguugccaugcuguauacaccgcuuaggucuaacggcucgggggaagaugucuucaccgugucaugccggguguugacucgcccuacacccgacuuugaguucaccuaccuggucccaccuagcguugaaaguaagacgaaacccuuuucccuaccaauccucacuauuggagagcugaccaacucuagauuccccgcuccuaucgaucaacuuuuuacaagcacuaauaacgacgugguagugcagccacagaaugguagguguacccuggauggcgaguugcaggggacaacccaacuccuguccacggccauaugcucauaucggggaacuacaaguaacccgauugacgauugggacgaccauuuacugcaccucacccaucccaauggcgcgacuuacgauccuacagaagacgucccagcccccuucgguacccaggauuuucaggggauccuuuacggaaugcugacgcagaacccucaaaccggcggcggggaggcagcuaauagccgcggaguguauauuucuuccacaucagacaaguucacuccaaaauuggguaccaucggccuacaccacguucaagggggagauguggccaacaaucaaaagagcaaguucacacccaucggcauugcugaaaacgguaauacuccguuucgacaguggguccugccuaacuacagugggagacucacccugaauacaaaccuugccccagcagugggccccaauuucccuggagagcagauacuguuuuucaggucuaacguacccuccguucagggcgggcauagcaucgaaauugacuguuugaucccacaggaguggauaucgcacuuuuaucaggagucugccccuucccagucagauguggcucucauucgguacgucaaccccgacaccggacguacucuguucgaagcgaaauuacaucgccaggguuuuaucacgaucgcaacaaccggcaauaacccaguggucgugccgccuaauggguauuucagauuugauaguuggguuaaccaguucuacgcccuggcucccaugggaacuggcaaugguaggcggcgagugcaauga

SEQ ID NO: 17989 - RNA, 1620 nt, Artificial Sequence
  derived and/or modified sequence opt3 from capsid_protein_VP1__Norovirus__BAJ25072
augaagauggccagcaacgacgcugcacccuccaaugauggcgccaccgggcuggugccugagaucaacacagaaacucucccacuugagccggucgcgggagcugccauugcagcccccguuacgggucagaauaacauaaucgacccuuggauuagaaccaauuucgugcaagcuccaaacggcgaauuuacaguaucucccaggaacucaccuggggagauccugaugaauuuggaauuaggaccagaucugaaucccuaccuagcacaccucgcccggauguauaacggcuacgcuggugggguggagguccaggugcugcuugccggaaaugcguucacugcaggcaaaauucuguuugccgcuguuccuccaaacuucccgguggacauguugagucccgcccagaucaccaugcucccucaucugauagucgaugugcgcacacuggagccaaucaugauuccccucccugacguacgaaauguguuuuaucacuacaacaaucagccagcaccccguaugagauuaguugcuaugcuguauaccccgcuuaggagcaacggcuccggggaagaugucuucacugugucuugccggguguugacacgcccuacccccgacuuugaguucacguaccuggucccaccuucgguugaaucaaagacuaaacccuuuagccuaccaauccucaccauuggagagcugacaaacaguagauuccccgccccuaucgaucaacuuuuuacuuccaccaauaacgacgugguagugcagccacagaaugguagguguacacuggauggcgaguugcaggggaccacgcaacuccugucuacugcggucugcagcuaucggggaacaaccuccaacccgauagacgauugggacgaccauuuacugcaccucacucaucccaauggcgccacauacgauccuaccgaagacgugccagcacccuucgguacgcaggauuuucaggggauucuuuacggaaugcugacccagaacccucaagcuggcggcggggaggccgcuucaagucgcggaguuuauaucagcucuacauccgacaaguucacuccaaaauuggguaccauuggccuacaccgagugcaagggggagccgucgcagauaaucagaagucaaaguucacacccaucggcaucgccgaaaacgacaauacuccguuuagacagugggugcugccuaacuacagcgguaggcucacccugaauacaaaccuugcuccagcgguagggcccaauuucccuggcgagcagauucuguuuuuccggaguaacguucccucugugcagggaggccacuccauagaaaucgauuguuugauuccacaggagugggucagccauuuuuaucaagagucggcaccuucucaguccgacguggcccucauccguuacgucaaucccgauaccgggcgcacucuguucgaagcuaaauuacacagacagggauuuauaacgauugccacaaccgguaacaacccagugguugugccgccuaauggcuauuucagguuugacucauggguaaaccaguucuacgcacuggcccccauggggacuggaaauggccggcgacgcguccaauga

SEQ ID NO: 17990 - RNA, 1608 nt, Artificial Sequence
  derived and/or modified sequence opt3 from capsid_protein_VP1__Norovirus__BAJ25076
augaagauggccagcaacgacgcuaaucccuccucugauggcucagcaaaccuggugccugagaucaguaaugaagucauggcccucgagccaguugcgggggcugccauugcagccccgguggcuggacagcaaaacauaaucgaccccuggauuagaaauaacuucguacaggcaccugguggcgaauuuaccgugagcccaaggaaugcccccggggagguccuucugaacuugccuuuauccccagauaucaaucccuaccuggcucaccuaucucggauguauaacggauacgccggcgguguggaaguugaggugguccucgcggggaaugcauucacagccggaaaaauuaucuuugcugccgugccuccaaacuucccgcccgagaaucugucgccuucacagauaacuaugcuuccacauaucauuguagacguucgccagcuggaacccgugcgaaucccuuugccagauguccguaacaauuuuuaucacuacagcagagagaacgacaguacgcucaggcugauugcaaugcuguauacaccccuccgggcuaacaaugccggcgaugacguguucaccguguccugccgcgucuuaacuagaccgucuccugauuuugacuucaucuuucugguucccccaaccguggaaagcaaguccaaaccuuucacaauacccaugcuuaccauugaggagaugacuaacucaagguuuccagcgcccuuggaacugaugacaaccggcccuagucaugauaucguagugcaaccacagaaugggcgguguacgauugacggaguccuacucgguacuacccagcugagcccggugaacaucugcucucuucgcggcguucccacaaagcgaacuaaugggaacgauaauuguuucgugcagcuggagaacccuaauggauccgccuacgacccaaccgaagacauccccgcagucuugggcucaccugauuuugugggugagcucuaugggacaauuacccaaagaagcagugacaacucuacgagggcucacccauucacucugaauacaggaagcccccgguacaccccgaaaauaggcuccguagauauccguguuacugacgugucggauuuacaggaccaugauccugucaagcugacaccagugggccucucuggggaccgcggauccauucaccaguggcagcuucccaacuacucaggugucgccacccacaauaugcaucuggcuccuaguguggcccccuuguucccaggcgaacaaauccuauuuuucagaagcacgguuccugggugcggaggcuaucccaacuccaauauagauugucugauuccacaggagugggugcagcacuuuuaccaagagggugcaccggccaggaccgacguagcucuccugcgguucaucaacccugauacagggcgaguccuuuuugaaugcaagcugcauaaacacggcuucaucacuguggcguauucuggaaaccacgacuugguuaugcccccaaauggcuacuuucgcuucgagagcugggugaaccaguuucauacccucgcacccauggggacaggaucagguagaaggcggauucaguga

SEQ ID NO: 17991 - RNA, 1644 nt, Artificial Sequence
  derived and/or modified sequence opt3 from capsid_protein_VP1__Norovirus__BAN16283
augaagauggccagcuccgacgcugcacccucuaacgauggcgccgcgaaucuggugccugaggcuaacaaugaagucauggcccucgagccaguugugggggcaucaaucgccgcuccgguagugggacagcaaaacauuauagaccccuggaucagagaaaauuucguccaggcaccucagggugaguuuaccgugaguccaaggaacagccccggcgaaaugcuucugaauuuggaguuagggccugagcugaacccauaccuaucccaccucucucggauguauaauggauacgccggcgguaugcagguucaagugguccuggcugggaacgccuucacagcgggaaaaauuaucuuugcagccgugcccccucauuucccaguagaaaauauuucggcugcccagaucacuaugugcccgcacguuauaguggauguccgccagcuugagcccgugcuguugccucucccagacauccgaaacagauuuuuccauuauaaucaggaaaacacgccccguaugaggcugguggcaaugcuguacaccccucuccgggcuaauucaggcgaggaugucuuuacaguuagcugucgcguguuaacuagaccagcccccgacuucgaguuuaccuuccugguaccgccuacaguggaaaguaagaccaaacccuuuacucuuccaauuuugacacugggcgagcuauccaacucuagguucccugcgcccaucgauaugcucuauaccgacccaaacgaagggauugucgugcaaccccagaauggacggugcacgcuggaugguacucuucagggcaccacacagcugguuccuacucaaaucugugccuuucgcgggaccuugauaggacagacaagccgauccucagacaguaccgauagcgcaccaagaaggcgggaccacccgcuccaugugcagcugaagaacuuagauggcacgcaauacgaccccacugacgaggucccugcugugcugggugccauugauuucaaagggacaguauucggaguugcuucucagcgugacguguccggcgaucaggucggcgccacccgcgcacacgaagugcacaucaauacuacagacccaagauauacccccaagcucgggucaauucuuaugcauagcgagaguggagauuuugucacgggucagccugugagguucaccccaaucggcaugggggacaacgauuggcaccaaugggagcugcccgacuacucuggacauuugacacuaaauaugaaccuggccccggcuguugcgccugcauuuccaggcgaacggauccucuucuuucgauccauugugcccagcgccgguggguacggcacuggacagauagauugccugaucccucaggaguggguacagcacuucuaucaagaagcugcccccucgcagucugcagucgcccuuauucgcuacgugaauccagacaccggcagaaacaucuuugaggcuaagcugcacagggaaggguucauaacaguugccaauuccggaaacaauccuauuguggugcccccaaacgguuauuuucgguucgaggcaugggucaaucaguuuuacacuuugaccccgaugggcacagggcagggacgcagaaggaaccaauga

SEQ ID NO: 17992 - RNA, 1644 nt, Artificial Sequence
  derived and/or modified sequence opt3 from capsid_protein_VP1__Norovirus__BAN16285
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaggaugucuuuacaguuucaugucgcguguuaacuagaccagcccccgacuucgaguuuaccuuccugguaccgccuacaguggaaagcaagaccaaacccuuuacucuuccaauuuugacacugggcgagcuaaguaacuccagguucccugcgcccaucgauaugcucuauaccgacccaaaugaagggauugucgugcaaccccagaacggacggugcacgcuggaugguacucuucagggcaccacacagcugguuccuacucaaaucugugccuuucgcgggaccuugauaggacagacaucucgaagcuccgacucaaccgauagugcaccaagaaggcgggaccacccgcuccaugugcagcugaagaauuuagauggcacgcaauacgaccccacugacgaggucccugcugugcugggugccauugauuucaaagggacaguauucggaguugcuagccagcgugacgugucuggccagcaggucggcgccacccgcgcacacgaagugcacaucaacacuacagauccaagauauacccccaagcucggguccauucuuaugcauucagagagcgacgauuuugucacgggacaaccugugagguucaccccaaucgguaugggcgacaaugauuggcaccagugggagcugcccgacuacagugggcauuugacacuaaacaugaaucuggccccggcuguugcgccugcauuuccaggagaacggauccucuucuuucgaucuauggugcccuccgccggcgguuacgggagcggccagauugauugccugauaccucaggaguggguacaacacuucuaucaggaagcugcccccucgcagucugcagucgcccuuauccgcuacgugaacccagacacuggaagaaauauuuuugaggcuaagcugcacagggaaggcuucaucaccguugccaacuccgggaauaacccuauaguggugcccccaaauggauauuuucgguucgaggcaugggucaaccaguuuuacacauugacuccgauggguaccggccaagggcgcagaaggaaucaguga

SEQ ID NO: 17993 - RNA, 1644 nt, Artificial Sequence
  derived and/or modified sequence opt3 from capsid_protein_VP1__Norovirus__BAN16287
augaagauggccagcaacgacgcugcacccuccaaugauggcgccgcgaaccuggugccugaggcuaauaacgaagucauggcccucgagccaguugcaggggccucuaucgcugcaccggugguaggacagcaaaauauuauagaccccuggaucagagaaaacuucgugcaggccccucagggugaguuuaccgucucaccaaggaauagucccggcgaaaugcuucugaacuuggaguuagggccugagcugaauccauaccuaagccaccucucccggauguauaacggauacgcuggcgguaugcaagugcagguugugcuggccgggaaugcguucacagcaggaaaaauuaucuuugccgcugucccuccucauuucccagugaagaacauuucugccgcacagaucacuaugugcccgcacguaauaguugaugugcgccagcuugaacccguccuguugccucucccagacauccgaaauagauuuuuccauuauaaccaggagaauacgccccguaugaggcugguggcuaugcuguacaccccucuccgggccaacucgggcgaagauguguuuacagucucaugucgcguuuuaacuagaccagcgcccgacuucgaguuuaccuuccuggugccgccuacaguagagagcaaaaccaagcccuuuacucuuccaauuuugacacugggcgaacuaaguaacuccagguucccugcccccaucgauaugcucuauaccgacccaaaugaggggauugugguccaaccccagaacggacggugcacgcuggaugguacucuucagggcaccacacagcuggugccuacucaaaucugugcauuucgcgggaccuugauaggacagacaucucgaagcuccgacucaaccgauagugcuccaagaaggcgggaccacccgcuccauguucagcugaaaaauuuagauggcacgcaauacgaccccacugacgaagugccugccguccugggugcuauugauuucaaggggacaguguucggaguagccagccagcgugacguuucuggccaacaggugggcgcaacccgcgcccacgagguccacaucaacacuacagauccaagauauacccccaagcucggguccauucuuauccauucagaaagcgacgauuuugugacgggacagccugucagguucaccccaaucgguaugggcgacaaugauuggcaccagugggagcugcccgacuacagugggcauuugacacuaaacaugaaucuggcuccggcgguggcacccgccuuuccaggagagcggauucucuucuuucgaucuaugguucccuccgcuggcgguuacgggagcggccagauagauugccugaucccucaggaaugggugcaacacuucuaucaggaggccgcacccucgcagucugccguagcucuuauucgcuacgucaacccagacacuggaagaaauaucuuugaagccaaacugcacagggagggcuucauaaccguggcaaacuccgggaauaacccuauuguugugccccauaauggauauuuucgguucgaagcgugggucaaccaguuuuacacauugacuccaauggguaccggccaagggcgcagaaggaaucaguga

SEQ ID NO: 17994 - RNA, 1644 nt, Artificial Sequence
  derived and/or modified sequence opt3 from capsid_protein_VP1__Norovirus__BAN16289
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaggaugucuuuacaguuucaugucgcguguuaacuagaccagcccccgacuucgaguuuaccuuccugguaccgccuacaguggaaagcaagaccaaacccuuuacucuuccaauuuugacacugggcgagcuaaguaacuccagguucccugcgcccaucgauaugcucuauaccgacccaaaugaagggauugucgugcaaccccagaacggacggugcacgcuggaugguacucuucagggcaccacacagcugguuccuacucaaaucugugccuuucgcgggaccuugauaggacagacaucucgaagcuccgacucaaccgauagugcaccaagaaggcgggaccacccgcuccaugugcagcugaagaauuuagauggcacgcaauacgaccccacugacgaggucccugcugugcugggugccauugauuucaaagggacaguacucggaguugcuagccagcgugacgugucuggccagcaggucggcgccacccgcgcacacgaagugcacaucaacacuacagauccaagauauacccccaaacuuggguccauucugaugcauucagagagcgacgauuucgucacgggacaaccugugagguuuaccccaaucgguaugggcgacaaugauuggcaccagugggaguugcccgacuacagugggcaucuaacacugaacaugaaucucgccccggcuguugcgccugcauucccaggagaacggauccuguuuuuccgaucuauugugcccuccgccggcgguuacgggagcggccagauagauugccuuaucccucaggaguggguacaacacuuuuaucaggaagcugcccccucgcagucugcagucgcccugauucgcuacgugaacccagacacuggaagaaauaucuucgaggcuaaguugcacagggaaggcuuuauaaccguugccaacuccgggaauaacccuauuguggugcccccaaauggauauuuccgguuugaggcaugggucaaccaguucuacacacucacuccgauggguaccggccaagggcgcagaaggaaucaguga

SEQ ID NO: 17995 - RNA, 1644 nt, Artificial Sequence
  derived and/or modified sequence opt3 from capsid_protein_VP1__Norovirus__BAN16291
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaagauacgccccguaugaggcugguggcaaugcuguacaccccucuccgggcuaauucgggcgaggacgucuuuacaguuucaugucgcguguuaacuagaccagcccccgauuucgaguuuaccuuccugguaccgccuacaguggaaagcaagaccaaacccuuuacucuuccaauuuugacacugggcgagcuaaguaacuccagguucccugcgcccaucgacaugcucuauaccgauccaaacgaaacgauugucgugcaaccccagaaugggcggugcacucuggacggaacccuucaggguacaacucagcugguuccuacccaaaucuguucuuuucgcggcacauugauaagccagaccucccgaucagccgauaguacggacagcgcaccaagagugaggaaccacccgcuccauguccagaugaagaaucuggaugggacucccuacgacccuacagacgaggugccagcuguauuaggagccauugauuucaaaggcaccguuuucgguguggcuucucaacggaacacuacaggaaauuccgucggggccacccgugcacacgaagugcacaucgacacgaccaacccccgcuauacaccuaagcugggcucaguccucaugaauagcgagaguucugauuuugacgauggccagccaauuagauucacucccaucgggaugggagccgacgauuggcaucagugggagcuuccggaauacuccggucaccugaccuugaacaugaaucuagcuccugcgguggcaccagccuuucccggcgagaggauccuguucuuucggagcguugugccuucggcugggggauacggcucuggucagauugacugccucauaccccaagaauggguacagcauuucuaucaggaggccgcaccaucccagucagccgucgcucugauccgauacgugaacccugauacagggcgcaauauuuuugaagccaaacuucacagagagggcuucaucacuguugcaaacaguggaaauaaccccauaguggucccaccgaauggcuauuuuagguucgaggcgugggugaaccaauuuuacacccugacaccuauggggaccggacagggucggcgcagaguacaguga

SEQ ID NO: 17996 - RNA, 1644 nt, Artificial Sequence
  derived and/or modified sequence opt3 from capsid_protein_VP1__Norovirus__BAN16293
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaagauacgccccguaugaggcugguggcaaugcuguacaccccucuccgggcuaauucgggcgaggacgucuuuacaguuucaugucgcguguuaacuagaccagcccccgauuucgaguuuaccuuccugguaccgccuacaguggaaagcaagaccaaacccuuuacucuuccaauuuugacacugggcgagcuaaguaacuccagguucccugcgcccaucgacaugcucuauaccgauccaaacgaaacgauugucgugcaaccccagaaugggcggugcacucuggacggaacccuucaggguacaacucagcugguuccuacccaaaucuguucuuuucgcggcacauugauaagccagaccucccgaucagccgauaguacggacagcgcaccaagagugaggaaccacccgcuccauguccagcugaagaauuuagaugggacucccuacgacccuacagacgaggugccagcuguacugggagccauugauuucaaaggcaccguuuucgguguggcuucucaacggaacacuacaggaaauuccgucggggccacccgugcacacgaagugcacaucgacacgaccaacccccgcuauacaccuaagcucggcucaguccuuaugaauagcgagaguucugauuuugacgauggccagccaauuagauucacucccaucgggaugggagccgacgauuggcaucagugggagcugccggaauacuccggucacuugacccuaaacaugaaucuggcuccugcgguggcaccagccuuucccggcgagaggauccucuucuuucggagcguugugccuucggcugggggauacggcucuggucagauugacugccugauaccccaagaauggguacagcauuucuaucaggaggccgcaccaucccagucagccgucgcucuuauccgauacgugaacccugauacagggcgcaauauuuuugaagccaagcugcacagagagggcuucaucacuguugcaaacaguggaaauaaccccauaguggucccaccgaauggcuauuuuagguucgaggcgugggugaaccaauuuuacaccuugacaccuauggggaccggacagggucggcgcagaguacaguga

SEQ ID NO: 17997 - RNA, 1644 nt, Artificial Sequence
  derived and/or modified sequence opt3 from capsid_protein_VP1__Norovirus__BAN16295
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagaagugcuggcugggaaugccuucacagcgggaaaaauuaucuuugcagccgugcccccucauuucccagucgagaacauuucugcugcccagaucacuaugugcccgcacguaauaguugaugugcgccagcuugaacccguccuguugccucucccagacauccgaaauagauuuuuccauuauaaccaggaggauacgccccguaugaggcugguggcaaugcuguacaccccucuccgggcuaauucgggcgaggacguguuuacagucucaugucgcguuuuaacuagaccagcccccgauuucgaauuuaccuuccuggugccgccuacaguagagagcaagaccaaacccuuuacucuuccaauuuugacacugggcgaacuaaguaacuccagguucccugcgcccaucgacaugcucuauaccgauccaaacgagacgauugugguccaaccccagaaugggcggugcacucuggacggaacccuucaggguacaacucagcuggugccuacccaaaucuguucuuuucgcggcacauugauaagccagaccucccgaucagccgauaguacggacagcgcaccaagaguuaggaaccacccgcuccaugugcagcugaagaauuuagaugggacucccuacgacccuacagacgaagucccagcugugcugggagccauugauuucaaaggcaccguauucgguguugcuucucaacggaacacuacaggguccucagugggagccacccgugcacacgagguccacaucgacacgaccaauccccgcuauacaccuaagcucggcagcgugcuuaugcauagugagucuuccgauuuugacgauggccagccaacuagauucacccccauugggaugggagccgacgauuggaggcagugggaacugccggaguacagcggucacuugacacuaaacaugaaucuggcuccugcggucgcaccagccuuucccggcgaacggauccucuucuuucgaucggugguuccuucugcugggggauacggcuccggucagaucgacugccugauuccccaagagugggugcagcauuucuaucaggaagccgcaccaucacagagugccguagcucuuauacgcuacgucaacccugauacugggagaaauaucuuugaggccaagcugcacagggagggcuucauuaccguggcaaacagcggaaauaaccccaucguugugccaccgaauggcuauuuucgguucgaagcgugggucaaccaauuuuacacauugaccccuauggggacuggacagggucgcagaagggugcaguga

SEQ ID NO: 17998 - RNA, 1653 nt, Artificial Sequence
  derived and/or modified sequence opt3 from capsid_protein_VP1__Norovirus__BAN16297
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagauaacauuucugcugcccagaucacuaugugcccgcacguuauaguggacguccgccagcuugaacccgugcuguugccucucccagauauccgaaauagauuuuuccauuauaaccaggagaauacgccccguaugaggcugguggcaaugcuguacaccccucuccgggcuaacucgggcgaagacgucuuuacaguuucaugucgcguguuaacuagaccagcccccgauuucgaguuuaccuuccugguaccgccuacaguggagagcaagaccaaacccuuuacucuuccagucuugacacugggcgaacuaaguaacuccagguucccugcggccauugacaugcucuauaccgaucccaaugagucuaucgugguucaaccacagaacgggcggugcacgcuggacggaacucuucaggguaccacacagcuggugcccacucaaauuugugcauuucgcggcaccuugaucagccagacagcucgagccgcugauuccgucgacucaccucagagagccagggaucacccacuccaugugcaaguaaagaaucuggacgggacccaguacgacccgacggaugacauacccgcaguuuuaggagccauugauuucaaaggcacuguguucggugucgcuagucagcgggacgugagcgggacacaggaacaaggacacuaugcgacccgugcacacgaggcccauaucgauacuacagacccuaaguacgcuccaaagcugggcaccauucucaucaaaucugauuccaacgacuuuaauacgaaccagcccauccgcuucaccccugucggcaugggggauaauaacuggagacagugggaacuuccagacuacucaggaaggcugacauugaauaugaaccuagcccccgcagugagcccgaguuuuccuggugagcggauucuguucuuucgaucuauaguuccauccgccggcggguauggaagcggcuacaucgauugccucauuccccaggagugggugcaacacuucuaucaggaagcugccccuucgcagucugcaguagcgcugguccgcuacgugaaucccgacacugguagaaacaucuuugaggcuaaacuucauagggaaggguuccugaccguugccaauuccggcaacaauccaauaguggucccucccaacggauauuuucgguucgaggcaugggugaaccaguuuuacacauuggccccaaugggcucagggcaaggacgcagaagggcucaguga

SEQ ID NO: 17999 - RNA, 1623 nt, Artificial Sequence
  derived and/or modified sequence opt3 from capsid_protein_VP1__Norovirus__BAR42289
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaccggaauuugugccuuccggggccgcgugacggcgcagaucaaucagcgagauagauggcauaugcaacuucagaaccugaaugguacuacauacgacccaaccgaugacgucccggcccccuuggggacuccugacuucaagggagugguuuuuggcauggugagucagaggaacgucggcaaugaugcaccagggagcacacgggcucaacaggccugggugucuaccuauucaccccaguucguaccuaaacuaggauccguuaaccugcguauaagcgacaaugaugacuuucaguuccaaccaacgaaguuuacccccgugggugucaacgaugacgaugacggccacccguuccgccagugggaacucccuaauuacaguggggagcugacacuuaacaugaaucuggcuccacccguggccccuaacuuucccggagaacagcucuuguucuuuagaucuuucgucccaugcuccggcgguuacaaccaggggauuaucgauugucugauuccucaagaguggauccagcauuuuuaucaggaaagcgcacccucgcagucugacguggccuuaaucagguacguuaauccagauacuggccggacccuguucgaggcuaagcuacaccgauccggauauauuacaguggcgcacucaggcgacuacccgcucguagucccugcaaacgggcauuuucgcuucgacaguugggugaaucaauucuauagccuggcccccaugggaacugguaacggcagaaggcgggcucaguga

SEQ ID NO: 18000 - RNA, 1617 nt, Artificial Sequence
  derived and/or modified sequence opt3 from capsid_protein_VP1__Norovirus__BAR47616
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauaauaaccagccaaacucccguaugagacugguugcaaugcuuuacacacccuugaggucuaaugggucgggagacgauguguucaccgucucaugccgggugcugacucgcccgacaccugacuuugaguucaccuaucuagugcccccaagcgucgaaaguaagacgaaaccuuuuucccuccccauucugacucuuucugagcugaccaacagcagauucccaguucccaucgauuccuuguuuacagcucaaaauaacgugcuccagguacagugucagaaugguaggugcacucuggacggcgaguuacaagggaccacacagcugcucccuucaggaauuugugccuuccggggccgcgugaccgcggaaacggaucaucgagacaaguggcacaugcagcuucagaaccugaaugguacuacauacgauccaaccgacgacgucccggcccccuuggggacuccugauuucaaaggagugguuuuuggcguggcaagucaaagaaacgucggcaaugacgcuccagggagcacaagggcccaugaggcugugaucucuaccuauucaccccaguucguaccuaagcuaggauccguuaacuuucggagcaaugauaacgacuuccagcugcaaccaacgaaguuuacccccguggguauaaaugaugacggcgaucacccguuccgucagugggaacucccugacuacagugggcugcuuacacugaacaugaauuuggccccacccgucgcaccuaacuuucccggagagcagcuccuguucuuucgcucuuucgugccaugcuccggcgguuacaaccaggggauugucgauuguuuaaucccucaagaauggauucagcacuuuuaucaggagagcgcccccucgcagucugacguggcucugaucagauacguuaauccagauacuggcaggacccuauucgaggcgaaacuccaucgguccggauauaucacaguggcacacucaggcgacuacccgcugguagucccugccaacggguauuuucgauucgacaguugggugaaucaauucuacagccuugcucccaugggaacugguaacggccgcagaagggcccaguga

SEQ ID NO: 18001 - RNA, 1617 nt, Artificial Sequence; identical to SEQ ID NO: 18000
  derived and/or modified sequence opt3 from capsid_protein_VP1__Norovirus__BAR63715

SEQ ID NO: 18002 - RNA, 1617 nt, Artificial Sequence; identical to SEQ ID NO: 18000
  derived and/or modified sequence opt3 from capsid_protein_VP1__Norovirus__BAR63718

SEQ ID NO: 18003 - RNA, 1617 nt, Artificial Sequence; identical to SEQ ID NO: 18000
  derived and/or modified sequence opt3 from capsid_protein_VP1__Norovirus__BAR63721

SEQ ID NO: 18004 - RNA, 1623 nt, Artificial Sequence
  derived and/or modified sequence opt3 from capsid_protein_VP1__Norovirus__BAS02083
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauacaaccggcagccacaacuacacgaugaaucucgcaucucagaacugguccaauuaugaucccacugaggaaaucccugcuccacuggguacacccgacuucgucgggaagauacagggagugcuuacccagacuacacggaccgacggcucaacgcgcggccauaaggccaccgucuacacagggagcgcugauuuugccccuaagcugggacgagugcaauucgagacugacaccaaccacgauuuugaagcaaaucagaacacaaaauucacuccaguuggugugauucaggacggcgggaccacacacagaaaugagccccaacaguggguauugccgaguuacucuggaaggaacaccccuaauguccaucucgccccagcuguggcgcccacuuuuccuggcgaacagcuguuauucuuucgguccacgaugcccgguuguagcggguauccaaacauggaucuggacugccuccuuccucaggaguggguucaauacuucuaucaggaggcagcccccgcucagucggauguggcccuguugcguuuugucaauccagacacaggccgcgugcuauucgaauguaagcugcacaaaucuggauacguaaccguggcacauacuggccagcacgaucucguuaucccgccuaacggguauuuuagauucgacuccugggucaaccaauucuacacccuggcccccaugggaaaugguacaggcaggcggcgagcucuuuga

SEQ ID NO: 18005 - RNA, 1635 nt, Artificial Sequence
  derived and/or modified sequence opt3 from capsid_protein_VP1__Norovirus__CRL46952
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaacgcgucuugaaccucacugagcuggacgggagcccauucauggcauucgcugccccggcgcccgccggauuuccugauuuagguucuugcgacuggcacauugagauguccaaaaucccaaauucaagcacacagaacaaucccauugugguaaacaguguuaagccuaauucucagcaguucgugccacaucuguccagcaucacccucgaugacaucgucucgucuggcggggauuacauuggaacgauacaauggaccucacccccguccgacaguggcggugcaaacacaaauuuuuggaagaucccugauuaugggagcucccuuucugaagcuagccagcuggccccagcuguguaucccccuggcuucaacgaggucauuguguacuuuauggccucaauccccggaccaaaucagaguggcuccccuaacuugguucccugucuacugccacaggaauacauaacucacuucauuagcgagcaagcaccgauccagggggaggccgcucuccugcacuacguggacccugauaccaaucgaaaccuuggagaauuuaaacuguaucccgguggcuacuugacaugcguaccaaauucuucaaguacugggccccagcagcucccucuggacggagucuucguguuugcgagcuggguuuccagauucuaucaauuaaagccagugggcaccgcaggucccgccagggggcggcugggcguccgucgcuga

SEQ ID NO: 18006 - RNA, 1623 nt, Artificial Sequence
  derived and/or modified sequence opt3 from capsid_protein_VP1__Norovirus__CRL46955
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccuauccagggcauguuuaugucccccgacgugaaccagucaguccaauuccagaaugguagaugucagauagaugggcaacugcagggaacaacuccagugagucuuagccagcugugcaagauuaggggcaaaaccucuuccaacgcacggguuuugaaccucucagagguggacggcacacccuucaucccucuggaaagcccagcuccggucggguuucccgacuuaggagguugugauuggcacgugaauuucaccuuucaggcccaaaaccaggacccuagucagucuguaacguucgcuacuaaugaugccuccuuuguuccauaucugggcagcauuucgccccauaacgggggagacuuccacgcaggcgauaucaucgguucucucggguggauuuccgccccuucagacaauagucagcuuaacguguggacaauaccaaaguacggcagcucccugcccgaugucacccacuuggcuccggcgguguuuccuccaggauucggcgaggucauccuauauuuuuacucuacuuuccccgggagcggacaaccuucacagcuccaggugcccugccugcugccacaggaauuuauuacacauuucuguaaugagcaagcaccuaucgccggugaggcugcccuucugcacuauguugaccccgauaccggccgcaacuugggggaauuuaagcucuacccagacggauucaugacgugcgugccgaauaguguauccagcggcccucagacccugcccauaaacggugucuucguguuuguuucuugggugucacgauucuaccaguuaaaaccagucgggacagcaagugccgcuagaaggcugggccuacggcguauuuga

SEQ ID NO: 18007 - RNA, 1623 nt, Artificial Sequence
  derived and/or modified sequence opt3 from capsid_protein_VP1__Norovirus__CRL46958
augaagauggccagcaacgacgcuaaucccuccgauggcucugcagccaaccuggugccugaggucaauaacgaaguuauggcgcucgagccagugguaggggcugccaucgcagccccgguggcuggacagcaaaauaucauagaccccuggaucagaaacaauuucguccaggcaccugguggcgaauuuaccgugucaccaaggaacgcccccggggagauucuuuggagugcuccucugggaccagauuugaaucccuacuuaagccaccuggcccggauguauaacggcuacgcggguggguucgaaguucaggugauccuagcaggaaaugccuuuacagcuggcaaaauuaucuucgccgcagucccuccaaacuuuccgacugagggccucucccccucucaggugacgauguucccucauauaaucguagacguucgccaacuggagccagugcuuauuccccugccugauguccgaaauaacuuuuaucacuacaaucagucgaacgacucaaccaucaaguugauugcuaugcucuauacaccacugcgugccaacaaugcgggggaugacguguucacugugagcugcagaguccugaccaggcccaguccggauuuugacuucaucuuucucguuccucccacaguggaaucccggaccaaaccauucacuauaccuauuuuaacaguagaggaaaugaccaacucucgcuuucccaucccacuggagaaacuuuacacgggacccagcuccgccuucgugguccagccucagaaugguagauguacuaccgauggcguguugcuggggacaacucaacuaucaccaguuaacauuugcaccuucaggggagacgugacaaauauccagggcagucauaccuauacgaugaaccucgcaagccugaauuggaacaauuacgauccgacugaggaaacacccgcuccucuugguaccccagacuuugucgggaagauccagggagugcugacucagacaaccaagggccaaggcucuacgcgggggcacaaggccaccguauacacaggauccgcuucauucacucccaaauuggguagcguucaguuucgcaccgacacacagaacgauuucgugacucaucaaaauaccaaguuuacaccugucggcgugauucaggacggggauaccacucaccgaaacgagccacagcaguggguccuccccaauuauaguggagugaacacgcacaauguucaucuggccccggcaguggccccuacaauaccaggcgaacaauuacuguucuuuagaucuuccaugcccgguuguagcggguacccuaacauggaccucgauugccuuguaccccaggaguggguccagcacuucuaucaggaagcugcgccagcacugucggacguggccuugcuaagguuuguuaacccugauaccggccgggugcuguucgaguguaaacuccauaagucuggauacgucacuguggcucacaccggccaccaugaccugguaauucccccaaauggguauuuucguuucgauuccugggugaaccaauuuuacacacuugccccgaugggaaaugguaccggccgcagaaggguucuguga

SEQ ID NO: 18008 - RNA, 1623 nt, Artificial Sequence
  derived and/or modified sequence opt3 from capsid_protein_VP1__Norovirus__CRL46961
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaucucauauuaccggcucccggaacuacacaaugaaucucgcaucacagaacuggaauaacuaugauccgaccgaggaaauccccgcuccucuggguacgccagacuucguugggaagauucagggaaugcuuacucagacaacccgcgccgacggcagcacucgaggccacaaggcuacaguguacaccgggagugccgauuuugcacccaagcugggaagaguccaauucgagacggacaccgaucaugacuuugaagccaaucagaacacaaaauucacuccugugggugucauccaggauggcucuaccacacacaggaaugagccacaacaguggguguugcccuccuacagcgggcggaacacucacaauguucaucucgcuccggcgguggcaccuaccuuuccaggagaacagcuguuauucuuucguucgacaaugcccggcuguucugguuauccuaacauggaccuggauugccuccuuccccaggaguggguacaauacuucuaucaggaggccgcuccagcccaguccgacgucgcacuguugcgcuuugugaauccugauaccgggagaguucuauucgaauguaagcugcacaaaucaggcuacgugacugucgcccauacgggacagcacgaccucgugauucccccaaacggcuauuuuagguucgauaguuggguaaaccaauucuacacacuggcuccgauggggaauggaaccggucggcgacgcgccguguga

SEQ ID NO: 18009 - RNA, 1623 nt, Artificial Sequence
  derived and/or modified sequence opt3 from capsid_protein_VP1__Norovirus__CRL46964
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagauuucgucgugcagccacagaacgguagauguacgacugacggcguauugcuggggaccacacaacuaaguccgguuaauauuugcacuuuuaggggagaugugacccauacaaccggcagccggaacuacacgaugaaucucgccucucagaacuggaauaacuaugaccccacugaggaaaccccugcaccacuggguacacccgacuucgucgggaagauccgcggaaugcuuacucagacaacccgagcugauggcuccacgagaggccacaaggccaccguguacacagggucagcugacuuugccccuaagcugggaaggguccaguucgagacugauaccgacaaugauuuugacgcaaaccaaaauacaaaauucacuccaguggguguuauacaggauggcaccacaacccaucggaacgaaccccgucaguggguguugccgagcuacagugggcgcaauacucacaacguacaccucgccccugcugucgcgccaacguuucccggagagcaacuguuauucuuuagaucuacaaugccuggcuguuccgguuaucccaauauggaccuggauugccuccuuccacaggaaugggugcaguucuuuuaccaggaggcagccccugcucaaagcgacguugcccuguugagguucgugaaccccgauaccgggcggguccuauuugaguguaagcugcauaaaucgggcuaugugacuguagcacacaccggaccacaugaccucgugauuccgccuaacggcuacuuccgauucgacucuuggguuaaucaguuuuauacacuggcccccauggggaacggaaccggucgcagaagggcugucuga

SEQ ID NO: 18010 - RNA, 1644 nt, Artificial Sequence
  derived and/or modified sequence opt3 from capsid_protein_VP1__Norovirus__CRL46967
augaagauggccagcaacgacgcugcacccuccaaugauggcgccgcgaaccuggugccugaggcuaccucugaagucauggcccucgagccaguugugggggcaucaaucgccgcuccgguagugggacagcaaaauauuauagaccccuggaucagagaaaacuucguccaggcaccucagggugaguuuacagugaguccaaggaauagccccggcgaaaugcuucugaacuuggaguuagggccugagcugaauccauaccuaucccaccucucucggauguauaacggauacgccggcgguaugcagguucaagugguccuggcugggaaugccuucacugcgggaaaaauuaucuuugcagccgugcccccucauuucccaguagaaaacauuucggcugcccagaucacgaugugcccgcacguuauaguggauguccgccagcuugagcccgugcuguugccucucccagacauccgaaaucguuucuuucauuauaaccaggaaaauacccccagaaugaggcugguggcaaugcuguacacaccucuccgggcuaacucaggcgaggaugucuuuacuguuagcugucgcguguuaaccagaccagcccccgacuucgaguuuacauuccugguaccgccuaccguggaaaguaagacuaaacccuuuacacuuccaauuuugacccugggcgagcuauccaauucuagguucccugcgcccaucgauaugcucuauacggacccaaacgaagccauugucgugcaaccccagaacgggcggugcacucuggauggaacccuucaggguacaacucagcugguuccuacccaaaucuguagcuuucgcggcacauugauaucccagaccucacgaagugcagacagcacggauucugcuccaagagugaggaaucacccgcuccauguccagcugaagaacuuagacgggacucccuacgauccuacagacgaggugccagccguacugggagcuauugacuucaaaggcaccguuuucgguguggccucccaacggaauacuacagggucaagcaucggagcaacccgugcccacgaaguccacauugauacgaccaacccccgcuaugcuccuaagcucggcagugugcuuauguacucugaguccacagacuuugaugacggccagccaacuagauucacccccaucgggaugggagcggaugacuggcaucagugggagcugccggaauacagcggucacuugacacuaaauaugaaccuggccccugcagucgcuccagccuuucccggcgagaggauccucuucuuucggucggugguuccuucugcagggggauauggcuccggucauauugauugccugauaccccaggaaugggugcaacacuucuaccaggaggccgcuccaucacagagugccguagcacuuauccgauaugucaauccugacacugggcgcaacauuuuugaagcgaagcugcacagagagggcuucaucaccguggcuaauagcggaaacaaucccauaguugugccaccgaacggcuacuuuagguucgaggccugggucaaucaguuuuauacauugaccccuauggggacuggacaaggucggcgcagagugcaguga

SEQ ID NO: 18011 - RNA, 1647 nt, Artificial Sequence
  derived and/or modified sequence opt3 from capsid_protein_VP1__Norovirus__CRL46970
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugauugccaugcuguacacuccccucagagcaaauaacucuggagaugacguuuucacagugucguguagggucuuaacucggccuucaccagauuuuagcuucaauuuucuggugcccccgaccguggagaguaagacaaaaccuuucucccuucccaucuugaccauaucugaaaugagcaacucccgcuuuccagucccuauugacucacugcauaccagucccacagagaauaucguugugcagugccagaacgguagaguaacccuagauggcgagcucauggggacgacucaacugcuuccaagccagauuugugcuuucaggggagugcugacccggucuacaucccgcgccucagaccaggcugauacugccacuccccgauuguucaauuauuacuggcacauccagcucgacaaccugaauggcacaccuuaugacccagcagaagauaucccgggucccuuagggaccccugacuuuagaggaaaggucuucggcguggccagccaaaggaaccuggauacgacuacacgggcucaugaggcgaaaauugacaccaccaguggccguuuuacaccaaagcucgggucucuugaaauauccaccgagagcucggauuucgaccagucucagcccacgcgcuuuaccccuguuggaaucgguguggaucacgaagcagacuuccaacaguggacacugccagauuacgccggccaguuuacucacaauaugaacuuggcucccgccgucgcaccgaauuucccuggggagcagcuacuguuuuucagaucccaucucccaucaaguggaggcaggagcaacgguauucuggacugccuugugccccaagaguggguacagcacuuuuaccaggaauccgccccuucucagagccaaguugcucuggugcgguaugucaaucccgauaccgggcgaguguuguucgaggccaagcuccauaaacugggcuuuaugacaaucgcaaagaacggagacucaccaauaauugucccucccaacggcuacuuccgcuucgaaaguugggugaauccauuuuauacuuuagcgccgauggggaccggaaacgguagaaggcggauccaguga

SEQ ID NO: 18012 - RNA, 1608 nt, Artificial Sequence
  derived and/or modified sequence opt3 from capsid_protein_VP1__Norovirus__CRL46973
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagguccuguuggaauuagagcugggaccugagcuaaauccauuccucgcccaccugagccggauguacaacggcuaugcuggugggguggaaguucaggugcuucuggccggaaaugcguuuacggcaggcaaauuggucuucgccgcuauucccccucauuuuccacucgagaaccuguccccgggccagaucaccauguucccccacgugaucauugauguacgcacacuggaaccuguucucuuaccacugcccgacgugcgaaauaacuuuuuccauuacaaucagcaaccugaggcccguaugaaacuugucgcaauguuguauacuccacugagaucuaacgggucgggagaugacguguuuaccgugucaugcaggguccuaacacggcccagcccggauuucgacuuuaacuaccucguuccucccaccguggagaguaagacuaagccauucacacugccuauccuuaccauaggugaacuguccaauucucgcuuucccguaccaaucgauauuuuguauacgagccccaacgagggcguggucgugcagccucagaaugggagauccacucucgacggagaacuguuaggcaccacacagaucguuccaucaaacauuugugcucugaggggucggaucaaugcccacgugccgaacgagcccaaucaauggaaccuccaggucacuaaugcgaacgggaccccuuucgauccaacagaagacgugcccgccccucuuggaaccccagauuuccaggcaaauauauacggcguaacgggccagcgcaacagugacagcucuugccgagcucaugacgggguucuggccacuuggucccccaaauuuacaccgaaguugggaucagugguccuagguaccugggagaaggaggauuucaauauuaaccaaccuacuagauuuacaccaaucggccugcacaauaccgaacacuucaaacagugggugcuccccaacuauagcgggaugcugacgcuuaacaugaaucuggcuccuagugucgcccccuuguuuccaggagagcagauucucuucuuuaggucuuucaucccucugaacggcgguaaguccgacggggcaaucgauuguuuacugccccaagaauggauucagcauuuuuaccaggagagcgccccaucgccgaccgacguggcucuaauacgguacacaaauccugauacuggccguguucucuucgaagcgaaacugcaccgccagggauuuaucaccguggcaucuuccggcucaaagcccauuguagucccacccaacggguauuucagauuugacaguugggugaaucaauucuacagccuugccccuaugggaacagguaacggcaggcggcgaguucaguga

SEQ ID NO: 18013 - RNA, 1623 nt, Artificial Sequence
  derived and/or modified sequence opt3 from capsid_protein_VP1__Norovirus__CRL46976
augaagauggccagcaacgacgcugcacccuccgauggcucuaccgccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaaaucauuuucgccgcagugccuccaaauuuuccgacggagggccucucccccucucagguaaccauguucccucauaucauaguugacgugcgccaacuggagccaguccuuaucccccugccugaugugcgaaacaauuuuuaucacuacaaccagucgaaugacccaacaauuaaguugaucgcuaugcucuauacuccccugcgugccaacaacgcgggggaugacguguucaccgucucaugcagaguucugacaaggccgagcccugauuuugacuucauuuuucucgugcccccaaccguagaaagucggacuaaaccuuucuccgugcccgucuuaacaguggaggaaaugaccaauucucgcuuuccaaucccccuggagaaacuuuucacgggaccuagcuccgccuucguugugcagccacagaacgguagauguacuaccgauggcgucuugcuggggacaacucaacuaucaccggugaauauaugcaccuuuaggggagacguaauucauauccccggcagucggaacuacacaaugaaucucgcaagccagaacuggaacucuuaugauccuaccgaggaaauuccagcuccccuggguacgccugacuucguugggaagauccagggagugcuuacucagacaacccgcacuaauggcuccacacgaggccacaaggccaccgucuacacggggucagcugacuuuagcccaaagcugggaagagugcaauucgccaccgauacagacaaugauuuugagacuaaccagaauaccaaauucacacccgucggugugauccaggacggcaguacuaccccgaggaacgaaccucaacaguggguuuugccaucuuacuccgggcggaauauucauaacgugcaccucgcacccgccguagcuccuacauuucccggagagcagcuguuauucuuucguagcaccaugccaggcuguucggguuauccuaauauggaucuggacugccuccuuccccaggaauggguccaauacuucuaucaggaggcggcaccagcccagucugauguggcucuguugcgcuuuguuaacccggacacugggagagugcuauucgaguguaagcugcacaaauccggcuacgucacgguggcccauacaggacagcacgaucucguaauaccucccaacggcuauuuuagguucgacucaugggugaaucaauucuacacccuggcaccaauggggaacggaacuggucggcgacgcgcccuuuga

SEQ ID NO: 18014 - RNA, 1623 nt, Artificial Sequence
  derived and/or modified sequence opt3 from capsid_protein_VP1__Norovirus__CRL46979
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaauucauauccccggcagccggaacuacacaaugaaucucgccucucagaacuggaacuccuaugauccuaccgaggaaauuccagcaccccuggguacgccugacuucguugggaagauccagggagugcuuacucagacaacccgcacuaauggcucaacacgaggccacaaggcuaccgucuacacggggagcgccgacuuuaguccaaagcugggaagagugcaauucgcuaccgauacagacaaugauuuugagacuaaccagaauaccaaauucacacccgucggugugauccaggacggcucuacuaccccgaggaacgaaccucaacaguggguuuugccauccuacagcgggcggaauauucauaacgugcaccucgcccccgcaguagccccuacauuucccggagagcagcuguuauucuuucguucgaccaugccaggcuguucugguuauccuaauauggaucuggacugccuccuuccccaggaauggguccaauacuucuaucaggaggcugcgccagcacaguccgauguggcccuguugcgcuuuguuaacccggacacugggagagugcuauucgaguguaagcugcacaaaucaggcuacgucacgguggcucauacaggacagcacgaucucguaauaccucccaacggcuauuuuagguucgacaguugggugaaucaauucuacacccuggccccaauggggaacggaacuggucggcgacgcgcacuuuga

SEQ ID NO: 18015 - RNA, 1623 nt, Artificial Sequence
  derived and/or modified sequence opt3 from capsid_VP1__Norovirus__ABC96332
augaagauggcccccaacgacgcuagcccuuccgauggcucuaccgcaaaucuggugccagaggucaacaaugaaguuauggcccucgagccggugguaggggcggcuaucgccgcacccguggccggacagcaaaacgucauugacccuuggauaagaaauaacuucgugcaggcuccagguggcgaauuuacaguuucacccaggaaugcaccuggggagauccuuuggagugccccacugggacccgauuugaacccuuacuuaagccaccuggcucggauguauaauggcuacgccgguggguucgaagugcaggucauucuagcgggaaacgcauuuacugccggcaaaaucauuuucgcugccgugccaccgaauuuucccacggagggccucuccccuucucagguaaccauguucccacauaucauaguugacgugcgccaacuggagcccguccuuaucccucugccagaugugcgaaacaauuuuuaucacuacaaccagucgaaugacucaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucacagugcccaucuuaaccgucgaggaaaugacuaauucucgcuuuccaauaccccuggagaaacuuuucacgggaccuagcuccgcguucgugguucagccacagaacgguagauguaccacagauggcguguugcuggggacuacccaacuaucaccggucaguauuugcacauuuaggggagacgugacccauauccccggcacgcggauuuaccgcaugaaucucgccagccagaacuggaauaacuaugauccuacugaggaaaucccagcaccccuggguacaccugacuucguagggaagauccagggaaugcuuacccagacuacaaagggcgacggcucuacccgagggcacaaggcuacgguuuccaccggaucaguggauuuuacaccaaaacuggguagcguccaauucgccacugacaccgauaaugacuuugagacaggccagaacacuagauucacccccgugggggucauucaggauggaaguucugcucauaggaaugaaccgcaacaguggguguugccugacuacuccggccggacaguucacaacgugcaccucgccccagcaguagcccccaccuuuccuggugagcagcuguuauucuuucguagcacuaugcccggguguucgggcuacccaaauauggaucuggacugccuccuuccucaggaauggguccaacauuucuaucaggaggcugcgcccucucaguccgauguggcacuguugcgcuuuguuaacccagacacgggaagagugcuauucgaguguaagcugcacaaagccggcuacgucacaguggcucauaccgggcagcacgaucucguaauaccgccuaauggauauuuuagguucgacucaugggugaaccaauucuacacucuggcccccauggguaauggcgcagggcggcgacgcgcccuuuga

SEQ ID NO: 18016 - RNA, 1623 nt, Artificial Sequence
  derived and/or modified sequence opt3 from major_capsid_protein_VP1__Norovirus__ADB27027
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcagucggaacuacacgaugaaucucgcaacucagaacuggaauagcuaugaucccacagaggaaauuccugcuccacuggguacccccgacuucguagggaagauccagggaguucuuacucagacaacccgcgccgacggcucuacgcgaggccacaaggcuaccguguacacaggguccgccgauuuuucaccuaagcugggaagaauccaauucgcaacugacaccgauaacgacuuugaugccaaucagaacacaaaauucacuccagucggugugauucaggacggcaauaccgcucauaggaacgagccccaacagugggucuugccgagcuacagugggcguaauucucacaacgugcaccucgcgccugcaguugccccaacauuucccggagaacagcuguuauucuuucgguccaccaugccuggcuguagcgguuaucccaauauggaucuggacugccuccuuccacaggagugggugcaauacuucuaucaggaagcugccccugcacagucggauguagcccuguugcgcuuugucaaccccgacacugggagagugcuauucgaguguaagcugcauaaaacgggcuacguuacaguggcucacaccggacagcaugaucucgucauaccaccgaacggcuauuuuagguucgacucuugggugaaucaauucuacacucuggccccuauggggaacggaaccggucggcgacgcgcacuuuga

SEQ ID NO: 18017 - RNA, 1626 nt, Artificial Sequence
  derived and/or modified sequence opt3 from major_capsid_protein_VP1__Norovirus__AEE10003
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguaauucagcccagacuuugcacgcaugcaagguggccagcuccuguguacggccuguuggucgaccccucccucccaucuaauccccaauggcagaacgggcgggugcgcguugauggaacucuguuaggcaccacaccugugagcgguuccugggucucauguuucgccgcugaagccgcauaugaguuucagagugggacuggagagguggccaccuucacacugaucgaacaagacggcagcgcuuacguaccaggcgaucgagcggcaccgcucggguaccccgacuuuucuggacagcuugagauugaaguucagaccgagacgacuaagacaggugacaaacugaaggugaccacuuucgaaauggucuugggcccugagacaaauguggaucaggccccauaucaagggagagucuacgcuuccgugaacgccgcagccucacuagaccugguugauggaagggugcgggcuguaccccguagcgucuauaguuuccaggacgugaucccugaguacaaugauggccuccugguuccacuugcacccccgauagguccuuuucugccaggggaaguguugcuccgcuucagaaccuauaugaggcagauugacacgaccgaugccgcggcugaggccaucgacugcgcacugccccaggaauuuauuucuugguucgccuccaacgcuuuuacaguccaaagcgaggccuuacugcuacgguaccgaaauacucucaccggccagcugcuuuucgaauguaaguuguauucggagggauacaucgcacugucuuacuccggcucaggggcucucacauuuccuacugauggauucuuugaggugguaaguugggugccccgccuguaucagcuugccagcguugguucccuggcgaccggcagaacauugaaacaguga

SEQ ID NO: 18018 - RNA, 1626 nt, Artificial Sequence; identical to SEQ ID NO: 18017
  derived and/or modified sequence opt3 from major_capsid_protein_VP1__Norovirus__AEE10006

SEQ ID NO: 18019 - RNA, 1626 nt, Artificial Sequence; identical to SEQ ID NO: 18017
  derived and/or modified sequence opt3 from major_capsid_protein_VP1__Norovirus__AEE10009

SEQ ID NO: 18020 - RNA, 1626 nt, Artificial Sequence
  derived and/or modified sequence opt3 from major_capsid_protein_VP1__Norovirus__AEE10015
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguaauucagcccagacuuugcacgcaugcaagguggccagcuccuguguacggccuguuggucgaccccucccucccaucuaauccccaauggcagaacgggcgggugcgcguugauggaacucuguuaggcaccacaccugugagcgguuccugggucucauguuucgccgcugaagccgcauaugaguuucagagugggacuggagagguggccaccuucacacugaucgaacaagacggcagcgcuuacguaccaggcgaucgagcggcaccgcucggguaccccgacuuuucuggacagcuugagauugaaguucagaccgagacgacuaagacaggugacaaacugaaggugaccacuuucgaaauggucuugggcccugagacaaauguggaucaggccccauaucaagggagagucuacgcuuccgugaacgccgcagccucacuagaccugguugauggaagggugcgggcuguaccccguagcgucuauaguuuccaggacgugaucccugaguacaaugauggccuccugguuccacuugcacccccgauagguccuuuucugccaggggaaguguugcuccgcuucagaaccuauaugaggcagauugacacgaccgaugccgcggcugaggccaucgacugcgcacugccccaggaauuugucucuugguucgccuccaacgcuuuuacagugcaaagcgaggccuuacugcuacgguaccgaaauacucucaccggccagcugcuuuucgaauguaaguuguauucggagggauacauugcacugucuuacuccggcucaggggcucucacauuuccuacugauggauucuuugagguagugaguuggguuccccgccuguaucagcuugccagcgucgguucccuggcgaccggcagaacauugaaacaguga

SEQ ID NO: 18021 - RNA, 1626 nt, Artificial Sequence; identical to SEQ ID NO: 18017
  derived and/or modified sequence opt3 from major_capsid_protein_VP1__Norovirus__AEE10018

SEQ ID NO: 18022 - RNA, 1626 nt, Artificial Sequence; identical to SEQ ID NO: 18020
  derived and/or modified sequence opt3 from major_capsid_protein_VP1__Norovirus__AEE10021

SEQ ID NO: 18023 - RNA, 1626 nt, Artificial Sequence
  derived and/or modified sequence opt3 from major_capsid_protein_VP1__Norovirus__AEE10024
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguaauucagcccagacuuugcacgcaugcaagguggccagcuccuguguacggccuguuggucgaccccucccucccaucuaauccccaauggcagaacgggcgggugcacguugauggaacucuguuaggcaccacaccuaucagcgguuccugggugucauguuucgccgcugaagccgcauaugaguuucagagugggauuggagaggucgccacuuucaaucugaucgaacaagacggcagcgcuuacaccccaggcgaucgcgcggcaccgcucggguaccccgacuuuucuggacagcuugagauagaagugcagacagagaccacgaagacuggugacaaacugaagguaacaaccuucgaaauggccuugggcccuaagacuaacguugaucagacaccauaucaagggcgaguguucgcuuccauuaccgucgccgcaucacuagaccugguggauggaagagucagggccgugccccggagcguuuacggcuuucaggacacgaucccugaguauaaugauggucuccuggugccacuugcucccccgauugggccuuuccugccaggcgagguauugcuccguuuucgcaccuacaugagacagcuggacgccacagaugcagcggcugaagccaucgacugcgcauuaccccaggaguucgucaguugguuugccucuaacgcuuucacugugcaauccgaagcccugcuacucagguaucggaauacccugacaggacagcuuuuguuugaguguaaacuguacagcgaaggcuauaucgcacucucguacucuggguccggaccucugacuuuccccaccgauggcuuuuucgagguugugucaugggucccacgacuuuaccagcuggcuaguguggguagcuuggccacagggcgcacccucaagcaguga

SEQ ID NO: 18024 - RNA, 1626 nt, Artificial Sequence
  derived and/or modified sequence opt3 from major_capsid_protein_VP1__Norovirus__AEE10027
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguacuucagcccagacugugcacgcaugcaagguggccagcuccuguguacggcuugcucgucgaccccucccugccaucuaauccccaauggcagaacgggcgggugcacguugauggaacuuuacugggcaccacaccugugagcgguuccugggucucauguuucgccgcugaagccgcauaugaguuucagagugggacuggagagguggccaccuucacaaugauugaacaagacggcagcgcuuacguaccaggcgaucgcgcggcaccgcucggguaccccgacuauucuggacagcuugagaucgaaguucagaccgagacgacuaagacaggugacaaacugcgagugaccacuuuugaaaugauuuugggcccuacaaccaaugucgaucaggccccauaccaagggaagguguaugcuucccuaucaacgagcgccagucugaaccucgucgacggaagagugagggcaguuccccggucuguguacuccuuccaggauguacugccugaguauaaugacggccuucuggucccauuggcucccccgcucgguccuuuccugccaggggagguguuacugcguuuucgcaccuacaugagacagcuagauacagccgacgccacugcacagcccaucgauugcgcgcucccucaagaguucauaagcugguuugcuucgaacaauuucaccguucagucugacgcccugcuuauuagguaucggaacacauugacuggccagcugcucuuugaagcaaagcuguacuccgaaggauacaucgccgugucauauaguggcagcgggccccuuaccuucccaacagauggauuuuucgaggucguguccuggguaccucgacuguuucaguuggcuucuguggguagccucgccaccggccgcacucugaaacaauga

SEQ ID NO: 18025 - RNA, 1608 nt, Artificial Sequence
  derived and/or modified sequence opt3 from major_capsid_protein_VP1__Norovirus__AGI96385
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagguccuguugaauuuagaacugggaccugagcuaaacccauuccucgcccaccugagccggauguacaauggcuaugcugguggggccgaggugcagguucuucuggcgggaaacgcauuuacggccggcaaauugguguucgcugccauucccccucauuuuccacucgaaaaucuguccccgggccagaucaccauguucccccacgucaucauugaugugcgcacacuggagccuguacucuuaccacugcccgacguucgaaacaacuuuuuccauuacaaucagcaaccugaaccacguaugagacuuguggcaauguuguauacuccccugaggucuaacgggucgggagaugacgucuuuaccgugucaugccgggugcuaacacgcccgagcccugauuucgacuuuaauuaccucguucccccaaccgucgagaguaagacuaaaccuuucacacugcccauccuuaccauaggugagcuguccaacucuagauuuccagugcccaucgaugaauuguauacgagcccuaaugagggcguaauugugcagccacagaacgggagguccacucucgacggagaacuguuaggcaccacacagcuggucccgucaaauaucugugcucuccggggucgcauuaacgcccaagugcccgaugaccaccaucaguggaaucuucagguuacuaacgcgaaugggaccaguuucgauccuacagaggacgugccaacgccccugggaaccccugacuucuuggccaacaucuacggcgucacuagccagcgaaauccagauaacacaugcagagcacacgacggcgugcuagcuaccuggucucccaaguuuacuccgaaacugggguccguaguucucggaacaugggaagagucagaucuggaccuuaaucaaccuaccagguucacgccagugggucuguaugauaccaaccacuuugaccaguggauauugcccaauuacagcggccggcucacacugaacaugaacuuagccccuagugucgcuccccuguucccaggggagcagauucuauuuuuccguucucauaucccucucaagggaggcacuuccaauggugccauugauugucugcuuccccaagaauggauccagcacuuuuaccaggagagcgcaccaucgccgaccgacguggccuugauccgcuauacaaacccugauacugggagaguccuguucgaagcuaagcuccauaggcagggcuuuauuaccguggcaaauucuggaucccggcccauaguugugccacccaacggcuacuuccgauuugacucauggguaaaucaauucuauagucuggcgccuauggggacaggaaacggucgcagaaggguccaguga

SEQ ID NO: 18026 - RNA, 1644 nt, Artificial Sequence
  derived and/or modified sequence opt3 from major_capsid_protein_VP1__Norovirus__AGI96397
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuaaugcugcccagaucacuaugugcccgcacguuauaguggauguccgccagcuugagcccgugcuguugccucucccagacauccgaaacagauuuuuccauuauaaucaggaaaacacgucucguaugaggcugguggcaaugcuguacacaccccuccgggcuaacucgggcgaggaugucuuuaccguuucaugucgcguguuaacuagaccugccccagacuucgaguuuaccuuccugguacccccgacaguggaaagcaagaccaaaccuuuuagucuucccauuuugacucugggcgagcuauccaauucuagguucccagcgccuaucgauaugcucuauacagaccccaacgaagggauugucgugcaaccacagaauggacggugcacccuggaugguacgcuucagggcacuacccagcugguucccacacaaaucugugccuuucgcgggacuuugauaggacagaccagccgauccccugacucaacagauagugcaccaagaaggcgggaccacccgcuccaugugcagcugaagaacuuagauggcacccaauacgaccccacggacgaggucccugcugugcugggugccauugauuucaaagggacuguauucggaguugcuagccagcgugacgugucuggccagcaggucggcgccacacgcgcacacgaagugcacaucaauaccacugauccaagauauacacccaagcucggguccauucuuauguacucagagagcgacgauuuugucaccggacaaccugugagguucacgccaaucgguaugggcgacaacgauuggcaucagugggagcugcccgacuacccggggcacuugacccuaaauaugaaccuggccccugcuguugcgccagcauuucccggagaacggauccucuucuuucgaaguauugugccuucugccggcgguuauggguccggccagauagauugccugaucccccaggaguggguacaacauuucuaccaggaagcugccccaagccagucggcagucgcccuuauucgcuaugugaauccugacacaggaagaaacaucuuugaggcuaagcugcacagggaaggcuucauaacuguugccaauucugggaacaaucccauuguggucccaccgaacggauacuuucgguucgaggcaugggugaaucaguuuuauaccuugacaccuauggguacuggccaagggcgcagaagggaucaguga

SEQ ID NO: 18027 - RNA, 1608 nt, Artificial Sequence
  derived and/or modified sequence opt3 from major_capsid_protein_VP1__Norovirus__AGI96398
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagguccuguugaauuuagaacugggaccugagcuaaacccauuccucgcccaccugagccggauguacaauggcuaugcuggugggguggagguucaggugcuucuggccggaaacgcguuuacggcaggcaaauuggucuucgccgcuauucccccucauuuuccacucgaaaaucuguccccgggccagaucaccauguucccccacgugaucauugauguacgcacacuggagccuguucucuuaccacugcccgacgugcgaaacaacuuuuuccauuacaaucagcaaccugaaccacguaugagacuugucgccauguuguauacuccccugaggucuaacgggucgggagaugacguguuuaccgugucaugccggguccuaacacgcccgagcccugauuucgacuuuaauuaccucguucccccaaccguggagaguaagacuaaaccuuucacacugcccauccuuaccauaggugagcuguccaacucuagauuuccaguacccaucgaugaauuguauacgagcccuaaugagggcgugauuguccagccacagaacgggagguccacucucgacggagaacuguuaggcaccacacagcuggugccgucaaauaucugugcacuccggggucgcauuaacgcucaaguucccgaugaccaccaucaguggaaucuucaggugacuaacgccaaugggaccaguuucgauccuacagaggacgucccagcgccccugggaaccccugacuucuuggccaacaucuacggcgugacgagccagcgaaauccagauaacacuugcagagcacacgacggcguacuagcuacauggucucccaaguuuaccccgaaacugggguccguugugcucggaacuugggaagagucagaucuggaccuuaaucaaccuacaagguucaccccagucggucuguaugauacgaaccacuuugaccaguggauauugcccaauuacagcggccggcucacccugaacaugaacuuagccccuaguguggcuccccuguucccaggggagcagauucuauuuuuccguucucauaucccucucaagggaggcacauccaauggugccauugauugucugcuuccccaagaauggauccagcacuuuuaccaggagagcgcaccaucgccgacugacgucgccuugauccgcuauaccaacccugauacagggagagugcuguucgaagcuaagcuccauaggcagggcuuuauuacuguugcaaauucuggaucccggcccauagugguaccacccaacggcuacuuccgauuugacucaugggucaaucaauucuauagucuggcgccuauggggaccggaaacggucgcagaagggugcaguga

SEQ ID NO: 18028 - RNA, 1608 nt, Artificial Sequence
  derived and/or modified sequence opt3 from major_capsid_protein_VP1__Norovirus__AGI96399
augaagauggccagcaacgacgcugcacccuccaaugaugacgccgcgggccuggugccugaggucaacaaugaaaccauggcucucgagccaguugccggggcaucuaucgccgcuccgcuuacaggacagaacaaugugauugaucccuggauaagaaugaacuucguacaagcaccuaauggugaauuuacugugucaccaaggaacagucccggcgagguccuguugaauuuagaacuggggccugagcuaaacccauuccucgcccaccugagccggauguacaauggauaugcuggcgguguggagguucaggugcuucuggccgggaacgcguuuacggcaggaaaguuggucuucgccgcuauucccccucauuuuccacucgaaaaucuguccccgggccagaucaccauguucccccacgugaucauugacguacgcacacuggagccuguucucuuaccacugcccgaugugcgaaacaacuuuuuccauuacaaucagcaaccugaaccacguaugagacuugucgccauguuguauacuccccugaggucuaacggcucgggggacgauguguuuaccgugucaugccggguccuaacacgcccgagcccugacuucgauuuuaauuaccucguucccccaaccguggagaguaagacuaaaccuuucgcacugcccauccuuacaauaggagagcuguccaacucuagauuuccaguacccaucgacgaauuguauaccagcccuaaugagggugugauuguccagccacagaacggcagguccacgcucgauggggaacuguuaggaacuacccagcuggugccgucaaauaucugugcucuccggggccgcauuaacgcccaaguucccgacgaucaccaucaguggaaucuucaggugacaaacgcgaaugguaccaguuucgacccuacugaggacgucccagcaccccuggggacaccugauuucuuggccaacaucuacggagugaccagccagcgaaauccagacaacacgugcagagcucacgauggcguacuagccacuuggucucccaaguuuacaccgaaacugggcuccguugugcucgggaccugggaagagucagaccuggaucuuaaucaaccuacuagguucacaccagucggacuguaugacaccaaccacuuugaucaguggauauugcccaauuacagcggucggcucacgcugaacaugaacuuagcuccuaguguggcaccccuguucccaggcgagcagauucuauuuuuccguucucauaucccucucaaagggggaaccuccaauggcgccauugacugucugcuuccccaagaauggauccagcacuuuuaccaggagagcgccccaucguugacagaugucgcucugauccgcuauacuaacccggacaccgguagaguucucuucgaagcgaagcugcauaggcagggguuuauuacaguggcaaauucuggcucccggccuauagugguacccccaaacggauacuuccgauuugauucaugggucaaucaauucuauagucuugcccccaugggcacugggaacggacgcagaagggugcaguga

SEQ ID NO: 18029 - RNA, 1617 nt, Artificial Sequence
  derived and/or modified sequence opt3 from major_capsid_protein_VP1__Norovirus__AGJ52175
augauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccuauccagggcauguuuaugucccccgacgugaaccagucaguccaauuccagaaugguagaugucagauagaugggcaacugcagggaacaacuccagugagucuuagccagcugugcaagauuaggggcaaaaccucuuccaacgcacggguuuugaaccucucagagguggacggcacacccuucaucccucuggaaagcccagcuccggucggguuucccgacuuaggagguugugauuggcacgugaauuucaguuuucagacccaagaccgcgauccuucucaguccguaacguucgccacuaacgacgcuagcuuuguuccauaucugggcucggugucuccccauaauggggagggauuccaggccggcgauauuaucgguucccucggguggaucucagcaccuagugacaacagccaguuuaaugucugggccauuccaaaguacggcuccucucuucaaaugagccccauacuguugcuacugugcucaccgcgacucugggaagugauccuguauuucuacaguacauuuccuggauccggccagccaagccagcuucagguccccugucuguugccucaagaguucauuacccacuuuugcaacgagcaggcucccaucgcgggggaagcagcccuccugcacuauguggauccagacacuggaagaaauuuaggugaguucaagcuguacccugauggcuuuaugacauguguucccaacucugugucaagugggccacagacccuaccgauaaauggaguauucgucuucgugagcuggguuuccagguuuuaccagcucaaaccugugggcacggcuucugccgcacggcgucugggucuucgcagaauuuga

SEQ ID NO: 18030 - RNA, 1641 nt, Artificial Sequence
  derived and/or modified sequence opt3 from major_capsid_protein_VP1__Norovirus__AGX01092
augaugauggccagcaaggacgcuccccaguccgcagauggcgccucuggggcgggacaacuggugccugaggucaacaccgcugacccacucccgauggaacccguugccgguccuacaacugcaguggccacggcuggccagguaaauaugaucgauccauggauugugaacaauuucguccagucaccccagggggaguuuaccauaaguccuaacaauacaccaggagacauccuuuucgaucugcaauugggcccccacuuaaacccuuuucugagccaucuaucccagauguacaaugguuggguggggaacaugagaguuaggauucuccuggcaggaaaugccuucucugcuggcaaaaucauugugugcuuugucccaccgggcuucacuucgucaagccuuaccaucgcccaggcgacacuguuuccccacgugauagcagacguacggaccuuggaaccuaucgagaugccacucgaagauguucgcaacgugcuguaucauacuaaugacaaccagcccacaaugcgacuggucuguaugcucuacaccccuuuacguacugggggagguaguggcuccucugauagcuucgugguggccgggagaguccugacggcuccauccucagacuuuaguuucuuguuucuuguucccccgaccauugagcaaaagacaagggccuucacugugccuaauaucccccugcagacccuaagcaacucucgguuuccaucccucauucagggaaugauccugucaccugaugcaagccagguagugcaauuccagaauggccgcugccuuauagacggucagcuguuggggacaacccccgcuacgaguggacaacucuucagagucaggggcaaaauuaaccagggcgcccggacucugaacuuaacagagguggaugggaagccauuuauggcguucgacucucccgccccuguuggauuuccagacuucgguaaaugugauuggcacaugcgcaucuccaagaccccgaauaacacuagcucgggcgaccccaugcgaucuguguccguccagacaaaugugcagggguuuguaccucaucugggaucaauucaauucgaugaaguuuuuaaccacccaaccggcgacuauaucgguacgaucgaguggauuagucagcccagcaccccuccagggacagauauaaaucucugggaaauccccgacuacggcuccucucuuagccaggcagcuaaccuggccccgccuguguucccacccggauuuggcgaggcuuuggucuauuucgugucagccuuuccugggcccaauaacagaagugcaccaaaugaugucccuugccuacugccccaggaguacauuacucacuucguguccgaacaagccccaaccaugggagacgcugcgcuccugcauuauguugauccggacacaaacaggaaucuuggugaguuuaagcuguacccuggcggguacuugacuugugugcccaacggaguaggcgcagguccacagcagcucccccugaauggggucuucuuauucgugagcuggguuucucgguuuuaucagcugaaaccugugggcaccgccucaacagcucguggacgccuaggcgucagaaggaucuga

SEQ ID NO: 18031 - RNA, 1647 nt, Artificial Sequence
  derived and/or modified sequence opt3 from major_capsid_protein_VP1__Norovirus__AGX01095
augaagauggccagcaacgacgcugcacccuccaaugauggcgccgcggggcuggugccugagaucucuucagaagcuauggcccucgagccagucgcaggagccgcuauugcagccccgcuuaccggucagcaaaacauaaucgaccccuggauuaugaauaacuucguucaggcuccuggcggggaauuuacagugaguccaagaaauagccccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuuccgccgcgcagauuacgaugugcccgcauguuaucguggacguccggcaacuggaacccgugaacuugccuaugccagauguacgcaauaacuucuuucacuauaaucaggggucugacucgcgacuccgucugauugccaugcuguacacaccccucagagcaaacaacucaggagaugacguuuucaccgugagcuguagggucuuaacucggccuaguccagauuuuuccuucaauuuucuggugcccccgaccguggagucuaagacaaaaccuuucagccuucccaucuugaccauauccgaaaugucaaacagucgcuuuccagucccuauugacagccugcauacuucucccacagagaauaucguugugcagugccagaacgguagaguaacccuagauggcgagcucauggggacgacucaacugcuuccaucccagauuugugcuuucaggggaacccugacacggucaacuagccgcgccagugaccaggcugauaccgccacaccccgauuguucaauuauuacuggcacauccagcucgacaaccugaauggcaccccuuaugacccagcagaagauaucccggcccccuuagguacgccugacuuuagagggaagguguucggagucgcuucucaaaggaacccagaugcgacuacacgggcacaugaggccaaaauugacaccacuuccggccguuuuacacccaagcugggcagccucgaaauaucgaccgagucuggggauuucgaccagaaucagccuacgcgcuuuaccccagugggaaucgguguugaucacgaacccgacuuccaacagugggcacuuccggauuacgccggccaguuuacacacaacaugaaucuggcuccugccguggcuccaaacuuccccggggagcaguugcuauuuuucagaucccaacugccuucaaguggaggcaggagcaaugguauucucgacugccuggucccccaggagugggugcagcauuuuuaccaggaauccgccccaucucaaacucagguagcacuuguucgguaugugaacccugauaccgggcgaguccuguucgaggcgaaguugcacaaacuccgcuuuaugacaaucgcuaagagcggcgacucacccauaacugugccaccgaauggauacuucagauucgaaaguugggucaacccuuuuuauacccuggcccccaugggcacagggaacggaaggcggcgcauucaguga

SEQ ID NO: 18032 - RNA, 1623 nt, Artificial Sequence
  derived and/or modified sequence opt3 from major_capsid_protein_VP1__Norovirus__AGX01098
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacugggugcccccgacuucgucgggaagauucagggagugcuuacucagacaacccgcacugacggcuccacacgaggccacaaggcuaccgucuacacggggucagccgauuuugcaccuaagcugggaagagugcaauucgagaccgacacagaucaugacuuugaaguuaaucagaacacuaaauucaccccaguggguguaauccaggauggcgggacaacucacaggaaugagccccaacagugggucuugccgagcuacaguggacggaacaccccuaaugugcaccucgccccagcuguugcgcccacauuuccuggcgaacagcuguuauucuuucguucuaccaugcccgguuguuccggguauccaaacauggaccuggauugccuccuuccucaggagugggugcaauacuucuaucaggaggcagcccccgcucagagcgacgucgcccuguugcgcuuugugaauccagauacuggcagaguacuauucgaauguaagcugcauaaaucgggauacgugacgguugcacacaacggccagcaugaccucgucauuccgccuaacggguauuuuagguucgauucuugggugaaucaauucuacacacuggcccccaugggaaacgguaccggccggcgacgcgcucuuuga

SEQ ID NO: 18033 - RNA, 1623 nt, Artificial Sequence
  derived and/or modified sequence opt3 from major_capsid_protein_VP1__Norovirus__AKI30060
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcauaaaccugcguauuagugacaaugaugacuuucaguuccaaccaaccaaguuuacgcccguuggugugaacgaugacgaugacggccacccguuccgccagugggaacucccuaauuacucuggggagcugacccuuaacaugaaucuggcuccacccgucgccccuaacuuucccggagaacagcucuuguucuuuagauccuucgugccaugcagcggcgguuacaaccaggggaucauugauugucugaucccucaagaguggauccagcauuuuuaucaggaaucggcacccucucaguccgacgucgccuuaauuagguacgugaauccagauacaggccggacucuguucgaggcuaagcuacaccgaucaggauauauaaccguugcgcacaguggcgacuacccgcucgugguaccugcaaacgggcauuuucgcuucgacagcugggucaaucaauucuauucccuggcccccaugggaacagguaacggcagaaggcgggcucaguga

SEQ ID NO: 18034 - RNA, 1626 nt, Artificial Sequence
  derived and/or modified sequence opt3 from major_capsid_protein_VP1__Norovirus__BAQ94514
augaagauggccagcaacgacgcugcacccuccaaugauggcgccgcgucucuggugccugaggcuauuaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuaucccaccucucucggauguauaauggauacgcuggcgguguggagguccaggugcugcuugccgggaacgcguucaccgcaggaaaaauucuguuugccgcuaucccuccaaauuucccgguugacaugauaucgcccgcccagaucacaauguugccucaucucauuguggauguccgcacucuggagccaaucaugauuccccugccugacgugcgaaacguauuuuaucacuucaauaaccagccacaaccccguaugagacucguugcaauguuauacaccccgcugaggucaaauggcagcggcgaugacguguuuacagucaguugccgggugcuuacccgcccuacucccgauuucgaauuuuucuauuuggugccaccuuccgucgagucuaagacaaagagcuuuacccugcccauccuaacgauauccgaaaugacuaacucaagauucccaauucccaucgagcagcucuacaccgcuccuaacgagacaaauguugugcagugucagaacgggaggugcacucuggacggagaacuucaagguaccacacagcuguugaguagcgccauuuguucuuaucggggccgcacccucgcgaauaacgauuccugggaccagaaucuguuacagcugucauacccaaacggggccagcuacgauccgacggacgagguacccgcaccucucggaacucaagacuuuaguggcauccuuuauggugugcugacacaggauaaugucaccgaagggacuggagaggcuaaaaacgccaaaggcaucuacauuucuacaaccuccggcaaguucacgccaaagauagggagcaucggauugcauucgauuaccggugacgugcaccauaaucagcaaucucgauucacacccguuggcaucgcugugaacgaaaauacuccuuuuaaacaguggguccuaccacacuauuccgggucacuggcccucaacaccaaucuggcacccgccguggcuccgacauucccuggagagcagcuucuguuuuucagaaguaggguaccaugcguucagggcuugcacggucaagaugcguuuauagacugucuccugccccaggagugggugaaccauuucuaccaggaagcagccccuagccagacugaugucgcuuuaauucgguuugugaaucccgacaccgggcguacacuguucgaggccaagcuacaccgcuccggcuuuaucaccgucucucauacuggaaacuauccacucgugaucccucccaacggccacuucagauuugauagcuggguuaaucaauucuacucacuggcaccaauggggacgggaaacgguaggcggcgaauccaguga

SEQ ID NO: 18035 - RNA, 1626 nt, Artificial Sequence
  derived and/or modified sequence opt3 from major_capsid_protein_VP1__Norovirus__BAQ94516
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuaucccaccucucucggauguauaauggauacgcuggcgguguggagguccaggugcugcuugccgggaacgcguucaccgcaggaaaaauucuguuugccgcuaucccuccaaauuucccgguugacaugauaucgcccgcccagaucacaauguugccucaucucauuguggauguccgcacucuggagccaaucaugauuccccugccugacgugcgaaacguauuuuaucacuucaauaaccagccacaaccccguaugagacucguugcaauguuauacaccccgcugaggucaaauggcagcggcgaugacguguuuacagucaguugccgggugcuuacccgcccuacucccgauuucgaauuuuucuauuuggugccaccuuccgucgagucuaagacaaaacccuuuacccugccaauccuaacgauaagcgaaaugacuaacuccagauuccccauuccuaucgagcagcucuacaccgcuccaaacgagacaaauguugugcagugucagaacgggaggugcacucuggacggagaacuucaagguaccacacagcuguugucaagugccauuuguagcuaucggggccgcacccucgcgaauaacgauucuugggaccagaaucuguuacagcuguccuacccgaacggggccucauacgaucccacggacgagguaccugcaccacucggaacucaagacuuuagcggcauccuuuauggugugcugacacaggauaaugucaccgaagggacuggagaggcuaagaacgccaaaggcaucuacauuaguacaaccucuggcaaguucacgcccaagauaggguccaucggauugcauagcauuaccggugacgugcaccauaaucagcaaucgcgauucacaccuguuggcaucgcugugaacgaaaauacuccauuuaaacaguggguccuaccccacuauucugggucccuggcccucaacaccaaucuggcaccggccguggcuccuacauucccaggagagcagcuucuguuuuucagaucaaggguacccugcguucagggcuugcacggucaagaugcguuuauagacugucuccugccucaggagugggugaaccauuucuaccaggaagcagcccccagucagacugaugucgcuuuaauucgguuugugaauccagacaccgggcguacacuguucgaggccaagcuacaccgcagcggcuuuaucaccgucucccauacuggaaacuauccucucgugauucccccaaacggccacuucagauuugauucuuggguuaaucaauucuacagccuggcaccgauggggacgggaaacgguaggcggcgaauccaguga

SEQ ID NO: 18036 - RNA, 1629 nt, Artificial Sequence
  derived and/or modified sequence opt3 from major_capsid_protein_VP1__Norovirus__BAQ94520
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgccccaaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccgucuggagcauccuacgaucccacggacgaggucccugcuccacucggcacucaagacuucucagguauccuuuauggggugcugacacaggauaauguuagcgaacgaaccggagaggccaagaacgcuaaaggcaucuacauuaguacuacaucuggcaaguuuacccccaagauaggguccaucggauugcauagcauuacggaaaaugugcacccuaaccagcaaucgagauucaccccagucgguguggcccagaaugagaacacacccuuccagcaguggguacuaccgcauuaugcaggcgcccuggcucucaauacuaaccuggcgccugcaguugccccaaccuuucccggggagcaacuucuguucuuuaggucucgggugccuugcguccagggauugcagggccaggacgcuuucaucgauugucuccugccccaagaaugggugaaucacuuuuaccaggaggccgcaccaucccaggccgacgucgcuuuaauacguuaugugaacccugauacaggucgcacucuguucgaagccaaacuacacagaucaggguuuauuaccguuagucauacaggcgcauacccccucgugguaccaccgaacggacacuucagguuugacagcugggucaaucaguucuauucccuggcgccuaugggcaccgggaacggacggcgacgcgugcaauga

SEQ ID NO: 18037 - RNA, 1629 nt, Artificial Sequence
  derived and/or modified sequence opt3 from major_capsid_protein_VP1__Norovirus__BAQ94524
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagcaucaaccacguaugagacucguugcuauguuauacacaccccugaggucgaauggcucaggcgaugacguguuuaccgucagcugccgggugcuuacccgcccgacuccugauuucgaauuuaucuauuuggugcccccaagugucgaguccaagacaaaaccuuucacccugcccauacuaacgauuucugaacucacuaacagcagauuuccaauccccauugagcagcuguacaccgccccuaacgagaauaacguugugcagugucagaaugggaggugcacacuugacggagaacugcaagguacuacccaguugcucuccucagcgguauguaguuaucggggccgcacaguggccaacagcggggauaauugggaccagaaccuguuacagcugaccuacccaucuggagcauccuacgauccgacggacgagguccccgcuccucucggcacucaagacuucucagguauccuuuauggggugcugacacaggauaauguuagcgaacgaaccggagaggccaagaacgcuaaaggcaucuacauuaguacuacaucuggcaaguuuaccccaaagauaggguccaucggauugcacagcauuacggaaaaugugcaucccaaccagcaaucgagauucaccccugucgguguggcccagaaugagaacacaccauuccagcaguggguacuaccccacuaugcaggcgcccuggcucucaauacuaaccuggcgccggcaguugccccuaccuuuccaggggagcaacuucuguucuuuaggucucgggugcccugcguccagggauugcagggccaggacgcuuucaucgauugucuccugccucaagaaugggugaaucacuuuuaccaggaggccgcacccucccaggccgacgucgcuuuaauacguuaugugaacccagauacaggucgcacucuguucgaagccaaacuacauagaucaggguuuauuaccguuagucacacaggcgcauacccucucgugguacccccaaacggacauuucagguuugacagcugggucaaucaguucuauucccuggcgccgaugggcaccgggaacggacggcgacgcgugcaauga

SEQ ID NO: 18038 - RNA, 1629 nt, Artificial Sequence
  derived and/or modified sequence opt3 from major_capsid_protein_VP1__Norovirus__BAQ94526
augaagauggccagcaacgacgcugcacccuccaaugauggcgccgcgucucuggugccugaggcuaucaacgaaaccaugccacucgagccggucgccggggcaucaauugccgcucccguugcaggacagacaaauauaaucgacccuuggauuagaacuaacuucgugcaagccccaaauggugaauuuacgguaagucccaggaacagcccuggcgagauccuucugaauuuggaauuagggccagaucugaaccccuaccuagcucaccucucccggauguauaauggauacgccggcgguguggagguccaggugcugcuugcggggaacgcauucaccgccggaaaaauucuguuugcugccaucccuccaaauuucccgguugacaugauaucucccgcacagaucacaauguugccucaucucauuguggauguccgcacucuggagccaaucaugauuccccugccugacgugcgaaacguauuuuaucacuucaauaaccagccacaaccccguaugagacucguugcuauguuauacaccccgcugaggucgaauggcucaggcgaugacguguuuacagucagcugccgggugcuuacccgcccuacucccgauuucgaauuuaucuauuuggugccaccuagugucgaguccaagacaaaacccuucacccugccaauacuaacgacuucugaacucaccaacagcagauuucccauuccuaucgagcagcuguacacagccccaaacgagaauaacguugugcagugucagaaugggaggugcacucuugacggagaacugcaagguaccacacaguugcucuccucagcgguauguaguuaucggggccgcaccguggccaacagcggggauaauugggaccagaaccuguuacagcugacguacccgucuggagcauccuacgaucccacugacgaggucccugcuccacucggcacacaagacuucucagguauucuuuauggggugcugacccaggauaauguuagcgaacgaacuggagaggccaagaacgcuaaaggcaucuacaucaguacaaccucuggcaaguuuacgcccaagauuggguccauaggauugcauagcaucaccgaaaaugugcacccuaaccagcaaucgagauucacaccagucgguguggcccagaaugagaacacucccuuccagcaguggguacuaccgcauuaugcaggcgcccuggcucucaauaccaaccuggcgccugcaguugccccaacauuucccggggagcaacuucuguucuuuaggucucgggugccuugcguccagggauugcagggccaggacgcuuucauugauugucuccugccccaagaaugggugaaucacuuuuaccaggaggccgcaccaucccaggccgacgucgcuuuaauccguuaugugaacccugauacuggucgcacccuguucgaagccaaacuacacagaucaggguuuauaacaguuagucauaccggcgcauacccccucgugguaccaccgaacggauauuucagguuugacagcugggucaaucaguucuacucccuggcgccuaugggcacugggaacggacggcgacgcgugcaauga

SEQ ID NO: 18039 - RNA, 1587 nt, Artificial Sequence
  derived and/or modified sequence opt3 from VP1_capsid_protein__Norovirus__ACV89840
augaugauggccagcuccgacgcuacacccccuucugagggcgcaacaaaccuggugccagaagucaauacucagguugugccgcucgagcccguagccggggcggcugccgcagccccuuucacgggacaaaacaaugugaucgauccauggauuuuucagaacuucguccaggcuccccagggugaauuuaccgugucaccuagaaauacaccaggcgagauacuucugaggauccccuuggggccuaacuuaaauccauuccuggcacaccuaagucggauguacaacgccuggguuggaggcauggaagcugagaugauucucgccgguaaugcguuuacugcagggaagcugcuuaucguggcccugccgcccggauucgaggcuacccaauugaccccugcccaggcaaccgcuuuuccacaugucauugccgacgugcgcacucucgaacccaucccuauaccacugcccgauauccgaaacguacuguuccacuauaauggcgacccgacaccuaccauucagaucguugugaugcucuacacgcccuuacguacuaacggcaauggggaugacgucuuuaccgugagcggaagacugcuuacaaggccagcgccugauuucuccuuuucuuucuuggugcccccaacugucgagcagaaaacccggucguuuacacugcccaaccuagccguuucagaccucagcaauagucgcuucccugcaccagugaacauucugagagcugauccgaacaccacgcuugcccuggacuaucaaaaugguaggugcacuuuggauggcgcucuccaggggacaacccccacuaacuccucuuuccugggauacuuacggggcacaguagaccgcgugaauagcgaucagguccaugugcaucugcgagaaccuaacggugacccauuucagcucgggcuucccggaccucaaggcguuccagacuauagagccacccuggauaucuacguggacugggagaauaagaaccacggcaaucccugugaggggacguugaacaccggaucccagacagaauauacuccgggucuaggcacccugacauucaauaaaacuucaggggauaccccugagcagggagacccagucauaaugaggcucguggcauuucggaguaaccugacagaucaacuucccgccuacaauggcgcuuucggucagggggaaaaccuggcgccucccguaagcccaccuguucccggcgagguguuuuugcaguucggaucucguuacacccgccucggcgaaagagagcuggcaguccagugcuuacugccauccgaguggauuacucacuuuuauucagaagccgcuccgauccaaggggaggccaugcuacucagguacgugcagccugaccugggacggauucuuuucgaagcaaaguuguauaaagaggguuuugucacgguggccggcgggacaaaucccguuaccuucccaaucgauggaacuuuuguggcuguaagcugggucagucgaaacuucgugcugucucccaugggcuccggucaggggcgcagaagggccgcacucgcggaauga

SEQ ID NO: 18040 - RNA, 1587 nt, Artificial Sequence
  derived and/or modified sequence opt3 from VP1_capsid_protein__Norovirus__ACV89843
augaugauggccagcuccgacgcuacacccccuucugagggcgcaacaaaccuggugccagaagucaauacucagguugugccgcucgagcccguagccggggcggcugccgcagccccuuucacgggacaaaacaaugugaucgauccauggauuuuucagaacuucguccaggcuccccagggugaauuuaccgugucaccuagaaauacaccaggcgagauacuucugaggauccccuuggggccuaacuuaaauccauuccuggcacaccuaagucggauguacaacgccuggguuggaggcauggaagcugagaugauucucgccgguaaugcguuuacugcagggaagcugcuuaucguggcccugccgcccggauucgaggcuacccaauugaccccugcccaggcaaccgcuuuuccacaugucauugccgacgugcgcacucucgaacccaucccuauaccacugcccgauauccgaaacguacuguuccacuauaauggcgacccgacaccuaccauucagaucguugugaugcucuacacgcccuuacguacuaacggcaauggggaugacgucuuuaccgugagcggaagacugcuuacaaggccagcgccugauuucuccuuuucuuucuuggugcccccaacugucgagcagaaaacccggcccuuuacacugccuaaccuagccguuucggaccucucaaauagccgcuucccagcaccggugaacauucugagagcugaucccaacaccacgcuugcccuggacuaucaaaaugguaggugcacuuuggauggcgcucuccaggggacaaccccuacuaacaguuccuuccugggauacuuacggggcacaguagaccgcgucaauucugaucaggugcaugugcaucugcgagaaccaaacggugaccccuuucagcucgggcuuccuggaccacaaggcguucccgacuauagagccacccuggauaucuacguggacugggagaauaagaaccacggcaauccgugugaggggacguugaacaccggaagccagacagaauauacuccuggucuaggcacccugacauucaauaaaacuuccggggauaccccagagcagggagaccccgucauaaugaggcucguggcauuucggucaaaccugacagaucaacuuccugccuacaauggcgcuuucggucagggggaaaaccuggcgcccccaguaaguccucccguuccaggcgagguguuuuugcaguucggaagccguuacacccgccucggcgaaagagagcuggcaguccagugcuuacugccgucugaguggauuacucacuuuuauuccgaagccgcuccuauccaaggggaggccaugcuacucagguacgugcagcccgaccugggacggauucuuuucgaagcaaaguuguauaaagaggguuuugucacgguggccggcgggacaaauccaguuaccuuccccaucgauggaacuuuuguggcuguaucaugggucagccgaaacuucgugcugaguccuaugggcucuggucaggggcgcagaagggccgcacucgcggaauga

SEQ ID NO: 18041 - RNA, 1767 nt, Artificial Sequence
  derived and/or modified sequence opt3 from VP1_capsid_protein__Norovirus__AFV48046
augagacugcagugggaggccuggaggagcaccuuccccggcaugcaaccuccaugcgugggguguggacucgguccgucccuucugcggccccgccgaaucguccagccuuacuuguuaaugcguaugucugacgcuguucacagaggcaacgcagccgauacacagggggcgucagcuggagaaggcaguaaucuggugccaagcacuguagaccaggccauucccauacaaccuguggccggugcagcuaucgcagccccaacggcugggcaggucaaccagauugaucccuggaucagggagaauuuugugcagugcccucuaggagaguucaccguuuccccacggaacacaccgggcgaagugcucuuuaaucuggcccuuggccccgggcugaacccuuauuugucucaucucgcggcaauguacacuggaugggucgguaauauggaagugcaacugguacuggccggcaacgcuuucaccgccgggaagguuguggucgcacucauuccacccuauuuuaauaugcagacauuaaccacuucgcagaucacauguuucccucacauaaugugcgacgugcgcacccuggagccaauccuuuugccccugcuagaugugagaaggacgcucuggcauccgacuaacucagaggacgauaccaugcggcuggucuguaugcuuuacacaccucugcgcacuaauagccccggagacgaaaguuuuguuguguccggccgauugcucucuagaccaagccuggauuucaacuuuuuauaucugaccccucccauugcucagacaccauacgagcuccccaccguaccuaggauggugccauccgaaaugacgcacucacgguggccggcccccaucuaucaagucguggcggacccuagucuuguugccaauccacaguggcagaacggucgugugacuauugaugggcaacuguugggaacaacccccaucagcucuacuugggucugcuccauagcaggcacagcugacuaccgcuacauugccggcaccgauucauucgaggaguguaaacuagcucugagccagccuaaugggaguccauuugugguaggagacgcccccgcaccguaugguuacccugacuucaacgccacgaucucuuuuuccuuccagguugaaaccagacagaacagcgcuuauucggugagggaguucucucucacaacuuccucacaaaccauuaaucagaguccauacacaggcacugucuauauggaucggagcgaaacccaggacuaccaguaucaagaugaccgaauccgcggggugccccauuccguccagucuuuuaaggaucagcugccugacuacguggagagcggacagcccccaaaccuugcgccucccaucggcccauucaugccgggugaaguucuggugagauuuaggacauacguacggcaagaggcaaccgccgcuuuguaucaggaucagccuauugacugcgcccucccccaggaguucgucacucaccuggcaacgcacggguacacauuaggcucagaugcccugcuacuccgcuauagaaaucugaggaccggacaacuuauaugugaagcuaaauuguacgccgagggcuuucuggcaaucaguuauuccgggacuggaccacuccagcugcccaccgacgguguguucgaaguugugagcuggguccagcgucuuuaccaacuggcgccugugggcacaucuaccgcugggcggucauugggaaguuga

SEQ ID NO: 18042 - RNA, 1767 nt, Artificial Sequence
  derived and/or modified sequence opt3 from VP1_capsid_protein__Norovirus__AFV48048
augagacugcagugggaggccuggaggagcaccuuccccggcaugcaaccuccaugcgugggguguggacucgguccgucccuucugcggccccgccgaaucguccagccuuacuuguuaaugcguaugucugacgcuguucacagaggcaacgcagccgauacacagggggcgucagcuggagaaggcaguaaucuggugccaagcacuguagaccaggccauucccauacaaccuguggccggugcagcuaucgcagccccaacggcugggcaggucaaccagauugaucccuggaucagggagaauuuugugcagugcccucuaggagaguucaccguuuccccacggaacacaccgggcgaagugcucuuuaaucuggcccuuggccccgggcugaacccuuauuugucucaucucgcggcaauguacacuggaugggucgguaauauggaagugcaacugauucuggccggcaacgcuuucaccgccgggaagguaguuguggcacucaucccacccuauuuuaauaugcagacauuaaccacuucgcagauaacauguuucccucacaucaugugcgacguccgcacccuggagccaauucuuuugccccugcuagaugugagaaggacgcucuggcauccgacuaacucagaggacgauaccaugcggcugguguguaugcuuuacacaccucugcgcacuaauagccccggagacgaaaguuuugucguuuccggccgauugcucucuagaccaagccuggauuucaacuuuuuauaucugaccccucccaucgcucagacaccauacgagcuccccaccgugccuaggaugauuccauccgaaaugacgcacucacgguggccggcccccaucuaucaaguaguggcggacccuagucuucuggccaauccacaguggcagaacggucgugucacuauagaugggcaauugcuaggaacaacccccauuagcucuacuugggugugcuccaucgcaggcacagcugacuaccgcuacauuucaggcagcgauaguuucgaggaguguaaacuggcccucucucagccuaauggguccccauuuguugugggagacgcucccgccccguaugguuacccugacuucagcgcaaccaucucguuuucuuuccaggucgaaacgagacagaacuccgccuauucagugagggaguucagucugaccacaagcucccaaacuaucaaccagucuccauacaccggcacaguauauauggaucggagcgaaacucuugacuaccaguaucaggaugaccgcauucgagggguuccccauucagugcacgcuuuuagagaucaacugccugacuacgucgagaguggacagcccccaaauuuggcgccucccauaggcccauucaugccgggugaagugcuccugagguuucggaccuacguccgccaggaggcaacagccgcuuuauaucaggaucaaccuaucgacugcgcccugccccaggaguucgugacccaccuagcaacucauggguacacgcucggcuccgaugcccugcuuuugagauauaggaaccugcguacaggacagcucauuugugaagcuaagcuguacgccgagggcuuucuugcaaucagcuauucugggaccggaccacugcaguugcccauagacgguguuuucgaagugguaucauggguccaacggcucuaccagcuggcgccugugggcacuagcaccgcugggcgaaguuuagccuccuga

SEQ ID NO: 18043 - RNA, 1623 nt, Artificial Sequence
  derived and/or modified sequence opt3 from VP1_capsid_protein__Norovirus__AGH06682
augaugauggccagcaaggacgcucccaccuccccugauggcgcaucuggggccggacagcuggugccagaagcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguuccauaauucuucgcagccucaaccaacuaugcgucucguagcuauguuauauacaccccugagaaccgggggagguucaggcgggacggaugccuuuguuguggcgggaaggguccuuacuugcccugccccagacuucagcuuuuuguuccuggugcccccgaguguggagcagaagacccgggucuuuuccguuccuaacauuccccuaaaagaucucucuaauagccgcgugccaguaccugugcagggcauguucaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcacacccuuuauuccucuggaaagcccagcuccggugggguuccccgacuuaggagguugugauuggcacguaaauuuuaccuuccaggcccaaaaccaggacccuagucagucuguuacguuugcuacuaaugaugccuccuucgugccauaccugggcagcaucucgccccauaacgggggagacuuucacgcaggcgauauuaucgguucucucggguggaucuccgccccuucagacaauagucagcuuaacgucuggacaauuccaaaguauggcagcucccugcccgaugugacccacuuggcuccggcggucuucccuccaggauuuggcgaggugauacuauacuucuauucuacuuuucccgggagcggacaaucaagucagcugcagguuccuugccuccugccccaggaguucaucacacauuuuuguaaugaacaagcaccaauugccggugaggcugcccuucugcacuacguggacccugauaccggccgcaacuugggggaguucaagcucuaucccgacggauucaugacgugcguaccaaauuccgucagcucuggcccgcagacccugccuaucaacgguguguuuguuuucgugucaugggucagucgauuuuaccaguuaaaacccguggggacagcaagcgccgcuagaaggcugggccuacggcguauauga

SEQ ID NO: 18044 - RNA, 1620 nt, Artificial Sequence
  derived and/or modified sequence opt3 from VP1_capsid_protein__Norovirus__AGL98413
augaagauggccagcuccgacgcuaaccccucugauggcucagcagccaaucuggugccugaggucaacaaugaaguuauggcgcucgagccagugguaggggcugccaucgcagccccgguggcuggacagcaaaacaucauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccaggcacaugacagcaccuugaagcucauugcuaugcuguauacaccacugcgugccaauaacgcgggggaugacguguucacugucaguugcagaguucucaccaggcccuccccggauuuugacuucaucuuuuuagugccucccacaguagaaucucggaccaaaccauucacugugccuauucugacagucgaggaaaugagcaacucccgcuuucccaucccacuugagaaguuguacaccggacccucaagugccuucgugguucagccucagaaugguagauguacgacugauggcgugcugcuagggaccacacaacucagcgcagucaacauaugcaauuucaggggagacgugacucggguaggcaccucucacgauuauacaaugaaccugguuucccagaauuggaacaauuacgacccaaccgaggaaauuccggcuccccuugguacgccugacuuuguggggaaaauccagggacuguugacucagacaacccgcgccgauggcucaacucgagcucauaaggccacagucagcaccggcagugugcacuucacgccaaagcucgggucuguccaauuuaccacagacacugauaacgacuuccagaccggacagaauacaaaauuuacucccguggguguuauucaagauggcgaccaccaucagaacgagccucagcagugggugcugccaaauuacuccgggaccagcggacacaacguacauuuagcacccgccgucgcuccggcguucccuggcgaacaacugcucuuuuucagaucgacaaugccagguuguucuggguaucccaauaugaaccuugauugccuguugccucaggagugggugcuacacuuuuaccaggaagcagcccccgcucaguccgacguugcccugcucagguucgugaauccagauaccggccggguccuguuugaguguaaacuucacaagucaggauauaucacuguggcacauacgggcccuuacgaccugguaauucccccaaacggguauuuccguuuugauaguugggugaaccaauucuacacauuggccccgaugggaaaugguaccggccgcagaagggcucucuga

SEQ ID NO: 18045 - RNA, 1620 nt, Artificial Sequence
  derived and/or modified sequence opt3 from VP1_capsid_protein__Norovirus__AGL98414
augaagauggccagcuccgacgcuaaccccucugauggcucaagugcaaaucuggugccugaggucaacaaugaaguuauggcccucgagccagugguaggggcggcuaucgccgcaccgguggccggacagcaaaacaucauagaccccuggaucagaaauaacuucguccaggcuccugguggcgaauuuaccgugagcccaaggaaugcacccggggagauucuuugguccgccccucugucuccagauuugaaccccuacuuaucgcaccugucacggauguauaauggauacgcuggcgguuucgaaguucaggugauccuagccgggaacgcguuuacagcaggaaaaauugucuucgccgcugugccuccaaauuuuccgacugagggccucagccccagucagguaacgauguucccucauaucauaguugacgugcgccaacuggagccaguccuuaucccccugccugaugugcgaaacaauuuuuaucacuacaaccaggccaaugacuccaccuugaagcucauugcaaugcuguauacaccacugcgugcuaacaacgccggcgaugacguguucacugucucuugcagaguucucaccaggcccagcccggauuuugacuucaucuuuuuagugccucccacaguagaaucccggaccaaaccauucacugugccuguccugacaguggaggaaaugaccaauucacgcuuucccauuccacuugagagauuguucacggggcccaguacugcguucguugugcagccucagaacggaagguguaccacagaugguguccugcuaggcacuacccaacucagcgccgugaauaucugcaacuuucgcggggagguaaaucauauagcaggaacacacgacuacaccaugcggcugacgucucagaacuggaauaacuaugauccaacugaagagauuccggcuccccuuggcacaccugacuucguuggucgaauccagggggugcugacccagacuacaagauccgacggaucaaccaggagccauaaggccacggucaguaccggcucugugcacuuuacaccaaaauugggcuccguccaauucacuaccgauacaacuaaugaccucaacgcugggcagaauaccaaguuuacacccgugggaguugaacagaccagcggugaucaccaaucggagccucagcaguggacucugccaaacuacucuggcacgcccaaucauaacgugcacuuagccccggcaguagccccuacauucccaggggaacagcugcucuuuuuccgguccacccuucccggauguggcgguuacccuaauaugaaccuggacugcuugcuaccccaagaguggguccugcauuuuuaucaggaggcugcgccagcacagucagauguggcccuccugcguuucguuaacccugacacugggcgcgugcuuuuugaauguaagcugcacagaaguggcuucauuaccgucgcucacagcggaucccaugauuuggugauucccccaaauggcuacuuuagguucgacucuuggguaaaccaguucuauacacucgccccgauggggaauggaagcggucggcgacgcgugguuuga

SEQ ID NO: 18046 - RNA, 1617 nt, Artificial Sequence
  derived and/or modified sequence opt3 from VP1_capsid_protein__Norovirus__AGL98416
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggaguaugccucugagcccagaauugaaucccuacuuaucccaccugucucggauguauaacggauacgcuggcgguuucgaggugcaggucauucuagccgggaaugcguuuacagcaggaaaaaucauuuucgccgcuaucccuccaaacuuuccgacugauggccucucgcccucacaggugacgauguucccucauauaaucguagacguucgccaacuggagccagugcuuauuccccugccugauguccgaaauaacuuuuaucacuacaaucaggccaacgacagcaccuugaagcucaucgcaaugcuguauacaccacugcgugcuaacaaugccggcgaugacguguucacugugaguugcagaguccucaccaggcccuccccggauuuugacuucaucuuuuuaguuccucccacaguggaaucucggaccaaaccauucacuguaccuauucugacaguggaugagaugaccaacagccgcuuucccacgccacuugaaaaguugcauacugggcccaauaacuccauagucgugcagccucagaauggaagauguaccauugacgguguucugcuaggcacaacucaacucucaaccgugaacaucugcaauuucagggggaguacaacccgggcgggacagagccacgccuacacgaugaaccuggucucucagaauuggaacaauuaugauccaacugaggagauuccggcaccccuuggcacaccugacuucguggguaaaaucguagggaugcugucccagaccacucgcgaaaacucaagcacacgagcucauaaggccaccguuaguacgggagacgcucacuuuaccccaaagucuggcuccguguuguucacaacugauaccgacgaucuccaaaauggccagaacacaagauuuacucccgucgggguggcccaggacggagagccucaccaaaaugaaccacagcaguggaggcugcccaacuacagcgguaccccgggccauaacguccacuuagcaccuccaguggcccccacauucccuggggagcagcugcucuuuuuccggucgaccaugcccggauguggcgguuacccaaauauggaucuugacugccuguugccucaagaauggguucgucauuuuuaucaggaggcugcgcccgcacagucugauguggcccuacugcgcuucguaaacccagacacugggagaguccucuuugaguguaaacugcacaaggcuggcuacaucacggugucccacacaggaccguaugaucuuguuauuccucccaauggcuacuucagguuugacucaugggugaaccaguucuaugcccuggcaccaauggggaccggaacuggucggcgacgcgccuuguga

SEQ ID NO: 18047 - RNA, 1629 nt, Artificial Sequence
  derived and/or modified sequence opt3 from VP1,_capsid_protein__Norovirus__BAL60749
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaguuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuuccccgugucuauagaucagauguacaccagcccaaacgaggucaucuccgugcagugucagaacgguagaugcacacuugacggcgaacugcaagggacuacccaguugcagguuucaggaauuugugccuuuaagggcgaggugacagcacaccuccaugauaaugaccaccuguauaacgucaccaucacgaauuuaaacgguagucccuucgacccuagcgaagaugugccagcuccgcuggggguacccgacuuccagggaaggguuuuuggcgugauuucucaacgggauaagcagaaugccgcuggccacaacgagccugccaaucgcgggcaugacgcagucgugccaacuuacacagcccaguacacccccaaacucggacaaguccagaucgguacuuggcagacagaugaccuucaggugaaccaaccuguuaaguucaccccagugggccugaaugauacggaacacuuuaaccaguggguagucccccgauaugcuggggcguugaaucuaaacaccaaucuggcaccguccguggccccuguuuucccaggagagagacuccuguuuuucaggucauacauaccccuuaaaggcgguuaugggaacccugcuauugacugccuguugccccaggagugggugcagcauuuuuaccaagaagccgcaccaagcaugagugaggucgcccucgugcgguauaucaauccugauacaggccgugcucuguucgaagccaaguuacaccgcgcaggauuuaugacuguaucuuccaacaccagcgcgcccgugguugucccagcuaacggcuacuucagauuugacucgugggugaaucaguucuauucucuggccccgauggggacaggaaacgguaggcggcgagugcaguga

SEQ ID NO: 18048 - RNA, 1629 nt, Artificial Sequence
  derived and/or modified sequence opt3 from VP1,_capsid_protein__Norovirus__BAL60753
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaaugucaccaucacgaacuuaaaugguucacccuucgacccuagugaagauauuccagcuccgcugggggugcccgacuuccagggaaggguauuuggcguuaucagccaacgggauaagcacaacucuccuggccauaaugagccagccaaccgcgggcacgacgcugugguccccacuuacacaucccaguacaccccuaaacucggacagauacaaauugguacuuggcagacagaugaccuuaccgugaaucagccagucaaguucacgcccgugggccugaacgauaccgaacauuuuaaucaguggguugugccgcgauaugccggggcauugaaccuaaauacaaaccuggccccuucaguagcuccagucuuccccggagagagacuccuguuuuucaggagcuacaucccucuuaaaggcgguuaugggaaucccgcgauugacugccuguugccacaagagugggugcagcacuuuuaccaggaagcagccccuaguaugucugagguugcucucgugcgguauaucaaccccgauacuggccgugcccuguucgaagcaaaguuacaccgcgccggauuuaugaccgucuccagcaacacaucggcuccagugguagugccggccaauggcuacuucagauuugacucuuggguuaaccaguucuauucccuggcaccuauggggacuggaaaugguaggcggcgaguccaauga

SEQ ID NO: 18049 - RNA, 1629 nt, Artificial Sequence; identical to SEQ ID NO: 18048
  derived and/or modified sequence opt3 from VP1,_capsid_protein__Norovirus__BAL60755

SEQ ID NO: 18050 - RNA, 1629 nt, Artificial Sequence
  derived and/or modified sequence opt3 from VP1,_capsid_protein__Norovirus__BAL60759
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaguuuagaacugggaccugagcuaaauccauaccucgcgcaccuggcacggauguauaacggccaugccggugggauggaggugcagguuaugcuugcuggaaaugccuucaccgcaggcaaacugguguuugcugccgugcccccucacuucccagucgaaaacuugagcccgcagcagaucacaauguuuccccauguaauuaucgauguucgcacucucgagccugugcugcugccacuccccgacguccgaaauaacuucuuucacuacaaucaaaaggaugacccuaaaaugcguauuguggcgauguuauauaccccacugagauccaacggcucuggggaugacguguucacagucucgugcaggguucuuacccggcccucaccggauuuugacuucacuuacuuggugccucccacaguagaaagcaagaccaaaccauuuacgcugccuauccuaacucucggagagcugaguaauucccgcuuccccgugucuauagaucagauguauaccagcccaaacgaggucaucuccgugcagugucagaacgguagaugcacacuugacggcgaacugcaagggacuacccaguugcagguuucaggaauuugugccuuuaagggcgaggugacagcacaucuccacgauaaugaccaccuguacaacgucaccaucacgaauuuaaacgguagucccuucgacccuagcgaagaugugccagcuccgcuggggguacccgacuuccagggaaggguuuuuggcgugauuucucaacgggauaagcagaaugccgcuggccauaacgagccugccaaucgcgggcacgacgcagucgugccaacuuauacagcccaguacacccccaaacucggacaaguccagaucgguacuuggcagacagaugaccuucaggugaaccaaccuguuaaguucaccccagugggccugaaugauacggaacauuuuaaccaguggguagucccccgauacgcuggggcguugaaucuaaacaccaaucuggcaccguccguggccccuguuuucccaggagagagacuccuguuuuucaggucauauauaccccuuaaaggcgguuacgggaacccugcuauugacugccuguugccccaggagugggugcagcacuuuuaucaagaagccgcaccaagcaugagugaggucgcccucgugcgguacaucaauccugauacaggccgugcucuguucgaagccaaguuacaccgcgcaggauuuaugacuguaucuuccaacaccagcgcgcccgugguugucccagcuaacggcuauuucagauuugacucgugggugaaucaguucuacucucuggccccgauggggacaggaaacgguaggcggcgagugcaguga

SEQ ID NO: 18051 - RNA, 1629 nt, Artificial Sequence
  derived and/or modified sequence opt3 from VP1,_capsid_protein__Norovirus__BAL60767
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccaaucgaaaauuugaguccgcagcagauuacaauguuuccccacgugaucauugauguacgcacucucgagccuguucugcugccacuccccgacgugcgaaacaauuucuuucauuauaaccaaaaggaugacccuaaaaugcguaucgucgcgauguuauacaccccacugagaagcaauggcuccggggaugacguguucacagugucuugcaggguccuuacccggcccucgccggauuuugacuucacuuauuugguuccucccacaguggaaucaaagaccaaaccauuuacgcugccuauacuaacucucggagagcugagcaacagucgcuuccccguauccaucgaucagauguacaccucuccaaacgaggugauuagcguccagugucagaaugguagaugcacacuugacggcgaacugcaagggacuacccaguugcaggucuccggaaucugugccuuuaagggcgagguuacagcacaccuccaugauaacgaccaccuguauaauauuaccaucacgaacuuaaaugguucacccuucgacccuagugaagauauaccagcuccgcuggggaugcccgacuuccagggaaggguguuuggcauuaucagccaacgggaucgccacaacucuccuggccauaaugagccagccaaccgagggcacgacgcugucgugcccacuuacacagcccaguacaccccuaagcucggacagauucaaaucgguacuuggcagacagaugaccuuaccguaucccagccaguuaaauucacgcccgugggccugaaugauaccgaacauuuuaaccagugggucgugccgagauaugcaggggccuugaaucuaaacacaaaucuggcuccuucagucgcgccaguguuccccggagagaggcuccuguuuuuccggagcuacaucccucuuaagggcgguuaugggaaccccgcaauugacugccuguugccacaagaguggguucagcacuuuuaccaggaagccgcuccuaguaugucugagguggcccucguacguuauauaaaucccgauacuggccgcgcacuguucgaagccaaauuacacagagcuggauuuaugaccgucuccagcaacacaucggccccagugguugugccggcaaacggcuacuucagguuugacucuugggucaaucaguucuauucccuggcgccuauggggacuggaaacggucggcgacgcgugcaauga

SEQ ID NO: 18052 - RNA, 1629 nt, Artificial Sequence
  derived and/or modified sequence opt3 from VP1,_capsid_protein__Norovirus__BAL60769
augaagauggccagcaacgacgcugugcccuccaccgauggcgcagccgggcuggucccugagucuaauaacgaaguuauggcgcucgagccaguggcuggagccgcacuugccgcuccgguaacaggucagacuaauaucauugaccccuggauaagagcaaacuucgugcaagccccuaauggcgaauuuacggucucaccaaggaacagucccggggaggugcuguugaauuuagaacugggaccugagcuaaacccauaccucgcucaccuggcccggauguauaauggcuacgcgggugggauggagguucaggugaugcuugcaggaaacgccuucaccgcuggcaaacuggucuuugccgcagugcccccucauuucccaguagaaaauuugagcccgcagcagaucacaauguuuccccacguuauuaucgaugugcgcacucucgagccuguccugcugccacuccccgacgugcgaaacaauuucuuucauuauaaccaaaaggaugacccuaaaaugcguauuguggcuauguuauacaccccacugagauccaauggcucuggggaugacgucuucacaguuucgugcagggugcuuacccggcccucaccggauuuugacuucacuuauuugguaccucccacaguggaaagcaagaccaaaccauuuacgcugccuauccuaacucucggagagcugaguaacucccgcuuccccgucucuauagaucagauguacaccagcccaaacgaggugaucuccguucagugucagaaugguagaugcacacuugacggcgaacugcaagggacuacccagcuccaggugucaggaauuugugccuuuaagggcgaggucacagcgcacuugcaugauaacgaacaccuguauaaugugaccaucacgaacuuaaaugguagucccuucgacccuagcgaggacauuccagccccgcuggggguacccgauuuccagggaaggguuuuuggcgugaucucucaacgggacaagcacaacacuccuggccauaaugaaccagcaaaccgcgcucacgaugccgucgugcccacauacaccgcucaguacacuccuaaacucgggcagguccaaauaggaacauggcagaccgacgaucuuacggacaaucagccagugaaguucacccccguuggucugaacgauacagagcauuuuaaucagugggugguaccgcgauaugccggcgcauugaaccuaaauacuaaccuggccccuuccgucgcuccaguguuccccggggagagacuccuguuuuucaggucauacauuccucuuaaaggaggcuaugguacccccgcgaucgacugccuguugccacaagaauggguucagcacuuuuaccaggaggcagccccuagcaugagugaaguggcucucguccgguauauuaaucccgauacagggcgugcccuguucgaggcaaaguuacaccgcgccggcuuuaugacugugucuuccaacaccagcgcuccaguagugguuccggccaacggauacuucagauuugacucgugggucaaucaguucuauucucuggcaccuaugggcacagggaacggaaggcggcgaauccaauga

SEQ ID NO: 18053 - RNA, 1629 nt, Artificial Sequence
  derived and/or modified sequence opt3 from VP1,_capsid_protein__Norovirus__BAL60771
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaauaucaccauuacgaacuuaaaugguucacccuucgacccuagugaagauaucccagcuccgcuggggguccccgacuuccagggaaggguguuuggcauaauuagccaacgggauaagcacaacucuccuggccauaaugagccagccaaccgcgggcacgacgcuguaguucccacuuacacagcccaguacaccccuaaacucggacagauccaaauugguacuuggcagacagaugaccuuaccgugucccagccagucaaguucacgcccgugggccugaaugauaccgaacauuuuaaccagugggucgugccgcgauaugcaggggccuugaaucuaaacacaaaucuggcuccuucaguugcgccaguguuccccggagagagacuccuguuuuucaggagcuacaucccucuuaaaggcgguuaugggaaccccgcaaucgacugccuguugccacaagaguggguacagcacuuuuaccaggaagccgcuccuaguaugucugaggucgcccucgugcgguauauuaaucccgauacuggccgugcacuguucgaagccaaguuacaccgcgcuggauuuaugaccguuuccagcaacacaucggccccaguggucgugccggcaaacggcuacuucagauuugacucuuggguaaaucaguucuauucccuggcgccuauggggacuggaaacgguaggcggcgagugcaauga

SEQ ID NO: 18054 - RNA, 1629 nt, Artificial Sequence
  derived and/or modified sequence opt3 from VP1,_capsid_protein__Norovirus__BAL60773
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaaugucaccaucacgaacuuaaaugguucacccuucgacccuagugaagauauuccagcuccgcugggggugcccgacuuccagggaaggguauuuggcaucauaagccaacgggauaagcacaacucuccuggccauaaugagccagccaaccgcgggcacgacgcuguugugcccacuuacacagcccaguacaccccuaaacucggacagauucaaaucgguacuuggcagacagaugaccuuaccgucaaucagccagugaaguucacgcccgucggccugaacgauaccgaacauuuuaaucagugggugguuccgcgauaugcaggggccuugaaccuaaauacaaaccuggcuccuuccguggcgccaguauuccccggagagagacuccuguuuuucaggucauacauuccucuuaaaggcgguuaugggaaucccgcaaucgacugccuguugccacaagaguggguccagcacuuuuaccaggaagccgcuccuagcaugagugagguggcccucguucgguauaucaaccccgauacuggccgugcacuguucgaagccaaguuacaccgcgcuggauuuaugaccgugucuuccaacacaagcgccccagucgugguaccggcaaauggcuacuucagauuugacucgugggugaaccaguucuauucucuggcgccuauggggacuggaaaugguaggcggcgaguucaauga

SEQ ID NO: 18055 - RNA, 1629 nt, Artificial Sequence
  derived and/or modified sequence opt3 from VP1,_capsid_protein__Norovirus__BAL60775
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccaaucgaaaauuugaguccgcagcagauuacaauguuuccccacgugaucauugauguacgcacucucgagccuguucugcugccacuccccgacgugcgaaacaauuucuuucauuauaaccaaaaggaugacccuaaaaugcguaucgucgcgauguuauacaccccacugagaagcaauggcuccggggaugacguguucacagugucuugcaggguccuuacccggcccucgccggauuuugacuucacuuauuugguuccucccacaguggaaucaaagaccaaaccauuuacgcugccuauacuaacucucggagagcugagcaacagucgcuuccccguauccaucgaucagauguacaccucuccaaacgaggugauuagcguccagugucagaaugguagaugcacacuugacggcgaacugcaagggacuacccaguugcaggucuccggaaucugugccuuuaagggcgagguuacagcacaccuccaugauaacgaccaccuguauaauauuaccaucacgaacuuaaaugguucacccuucgacccuagugaagauauaccagcuccgcugggggugcccgacuuccagggaagggucuuuggcauuaucagccaacgggauaagcacaacucuccuggccauaaugagccagccaaccgcgggcacgacgcugugguacccacuuacacagcccaguacaccccuaaacucggacagauucaaaucgguacuuggcagacagaugaccuuaccguuucccagccagugaaguucacgcccgucggccugaaugauaccgaacauuuuaaccaguggguggucccgcgauaugcaggggccuugaaucuaaacacaaaucuggcuccuucaguggcgccaguuuuccccggagagagacuccuguuuuucaggagcuacaucccucuuaaaggcgguuaugggaaccccgcaauugacugccuguugccacaagagugggugcagcacuuuuaccaggaagccgcuccuaguaugucugagguagcccucguccgguauauaaaucccgauacuggccgugcacuguucgaagccaaguuacaccgcgcuggauuuaugaccguguccagcaacacaucggccccaguuguggucccggcaaacggcuacuucagauuugacucuugggugaaucaguucuauucccuggcgccuauggggacuggaaacgguaggcggcgaguacaauga

SEQ ID NO: 18056 - RNA, 1629 nt, Artificial Sequence; identical to SEQ ID NO: 18055
  derived and/or modified sequence opt3 from VP1,_capsid_protein__Norovirus__BAL60777

SEQ ID NO: 18057 - RNA, 1629 nt, Artificial Sequence; identical to SEQ ID NO: 18055
  derived and/or modified sequence opt3 from VP1,_capsid_protein__Norovirus__BAL60779

SEQ ID NO: 18058 - RNA, 1629 nt, Artificial Sequence
  derived and/or modified sequence opt3 from VP1,_capsid_protein__Norovirus__BAL60781
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaaugucaccaucacgaacuuaaaugguucacccuucgacccuagugaagauauuccagcuccgcugggggugcccgacuuccagggaaggguauuuggcaucguuagccaacgggauaagcacaacucuccuggccauaaugagccagccaaccgcgggcacgacgcugugguccccacuuacacagcccaguacaccccuaaacucggacagauacaaauugguacuuggcagacagaugaccuuaccgugaaucagccagucaaguucacgcccgugggccugaacgauaucgaacauuuuaaucaguggguugugccgcgauaugcaggggccuugaaccuaaauaccaaccuggcuccuuccguagcgccagucuuccccggagagagacuccuguuuuucaggucauacauuccucuuaaaggcgguuaugggaaucccgcaaucgacugccuguugccacaagagugggugcagcacuuuuaccaggaagccgcuccuagcaugagugagguugcccucgugcgguauaucaaccccgauacaggccgugcacuguucgaagccaaguuacaccgcgcuggauuuaugacugucucuuccaacaccagcgccccagugguagugccggcaaauggcuacuucagauuugacucguggguuaaccaguucuauucucuggcgccuauggggacaggaaaugguaggcggcgaguccaauga

SEQ ID NO: 18059 - RNA, 1629 nt, Artificial Sequence
  derived and/or modified sequence opt3 from VP1,_capsid_protein__Norovirus__BAL60783
augaagauggccagcaacgacgcugcacccuccaccgauggcgccgcggggcuggugccugagucuaauaacgaagucauggcucucgagccaguugccggagcagcccuugcugcaccggugacaggucagacuaauauuauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaacaccuguauaaugucaccaucauuaacuuaaaugguagucccuucgacccuagcgaggacaucccagcaccgcugggggugcccgauuuccagggaaggguauuuggcguuauaucucaacgggacaagcacaacacgccuggccauaaugaaccagcuaaccgcgcccacgaugcugugguccccacuuacacagcccaguacaccccuaaacucgggcagauucaaaucggaacuuggcagacagacgaucuuaccaauaaccagccagugaaguucacgcccgucggucugaaugacaccgagcauuuugaucagugggugguuccgcgauaugcaggcgccuugaaccuaaauacaaaccuggcuccuuccguggcgccaguauuccccggggagagacuccuguuuuucaggucauacauuccucuuaaaggaggcuaugguacucccgcaaucgacugccuguugccacaagaauggguccagcacuuuuaccaggaggccgcuccuagcaugagugaaguggcccucguucgguauaucaaucccgauaccgggcgugcacuguucgaggccaaguuacaccgcgcuggcuuuaugacagugucuuccaacacuagcgccccagucgugguaccggcaaacggauacuucagauuugacucgugggugaaucaguucuauucucuggcgccuaugggcaccgggaacggaaggcggcgaauccaauga

SEQ ID NO: 18060 - RNA, 1629 nt, Artificial Sequence
  derived and/or modified sequence opt3 from VP1,_capsid_protein__Norovirus__BAL60785
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccaaucgaaaauuugaguccgcagcagauuacaauguuuccccacgugaucauugauguacgcacucucgagccuguucugcugccacuccccgacgugcgaaacaauuucuuucauuauaaccaaaaggaugacccuaaaaugcguaucgucgcgauguuauacaccccacugagaagcaauggcuccggggaugacguguucacagugucuugcaggguccuuacccggcccucgccggauuuugacuucacuuauuugguuccucccacaguggaaucaaagaccaaaccauuuacgcugccuauacuaacucucggagagcugagcaacagucgcuuccccguauccaucgaucagauguacaccucuccaaacgaggugauuagcguccagugucagaaugguagaugcacacuugacggcgaacugcaagggacuacccaguugcaggucuccggaaucugugccuuuaagggcgagguuacagcacaccuccaugauaacgaccaccuguauaaugugaccauuacgaacuuaaaugguucacccuucgacccuagugaagauaucccagcuccgcuggggguccccgacuuccagggaaggguguuuggcauaauuagccaacgggauaagcacaacucuccuggccagaaugagccagccaaccgcgggcaugacgcuguaguucccacuuacacagcccaguacaccccuaaacucggacaaauccagauugguacuuggcagacagaugaccuuaccgugucccagccagucaaguucacgcccgugggccugaaugauaccgaacacuuuaaccaaugggucgugccgcgauaugcaggggccuugaaucuaaacacaaaucuggcuccuucaguugcgccaguguuccccggagagagacuccuguuuuucaggagcuacaucccucuuaaaggcgguuaugggaaccccgcaaucgacugccuguugccacaggaguggguacagcauuuuuaccaggaagccgcuccuaguaugucugaggucgcccucgugcgguauauuaaucccgauacuggccgugcacuguucgaagccaaguuacaccgcgcuggauuuaugaccguuuccagcaacacaucggccccaguggucgugccggcaaacggcuacuucagauuugacucuuggguaaaucaauucuauucccuggcgccuauggggacuggaaacgguaggcggcgagugcaguga

SEQ ID NO: 18061 - RNA, 1629 nt, Artificial Sequence; identical to SEQ ID NO: 18055
  derived and/or modified sequence opt3 from VP1,_capsid_protein__Norovirus__BAL60791

SEQ ID NO: 18062 - RNA, 1629 nt, Artificial Sequence; identical to SEQ ID NO: 18055
  derived and/or modified sequence opt3 from VP1,_capsid_protein__Norovirus__BAL60793

SEQ ID NO: 18063 - RNA, 1629 nt, Artificial Sequence; identical to SEQ ID NO: 18055
  derived and/or modified sequence opt3 from VP1,_capsid_protein__Norovirus__BAL60795

SEQ ID NO: 18064 - RNA, 1629 nt, Artificial Sequence; identical to SEQ ID NO: 18055
  derived and/or modified sequence opt3 from VP1,_capsid_protein__Norovirus__BAL60797

SEQ ID NO: 18065 - RNA, 1629 nt, Artificial Sequence
  derived and/or modified sequence opt3 from VP1,_capsid_protein__Norovirus__BAL60799
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaacuucacccccgcaggucuguccgauacagaccauuuuaaucagugggugguuccgcgauaugccggcgcuuugaaccuaaauacuaaccuggcgccuucaguggcaccaguauuccccggggaaagacuccuguuuuucaggagcuacaucccucuuaagggaggcuaugguacccccgccauugauugccuguugccacaagaguggguccagcacuuuuaccaggaggcugccccuaguaugucugaaguggcacucguucgguauaucaaucccgacacagggcgugcccuguucgaggcuaaauuacaccgcgccggcuuuaugacuguguccagcaacaccucggcaccagucgugguaccggcgaacggauacuucagauuugauucuugggugaaucaguucuauucccuggcuccuaugggcacagggaacggaaggcggcgaauccaauga

SEQ ID NO: 18066 - RNA, 1629 nt, Artificial Sequence; identical to SEQ ID NO: 18055
  derived and/or modified sequence opt3 from VP1,_capsid_protein__Norovirus__BAL60801

SEQ ID NO: 18067 - RNA, 1629 nt, Artificial Sequence; identical to SEQ ID NO: 18055
  derived and/or modified sequence opt3 from VP1,_capsid_protein__Norovirus__BAL60803

SEQ ID NO: 18068 - RNA, 1629 nt, Artificial Sequence
  derived and/or modified sequence opt3 from VP1,_capsid_protein__Norovirus__BAL60805
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggccaugccggugggauggaggugcagguuaugcuugcuggaaacgccuucaccgcaggcaaacugguguuugcugccgugcccccucacuucccaaucgaaaauuugaguccgcagcagauuacaauguuuccccaugugaucauugauguacgcacucucgagccuguucugcugccacuccccgacgugcgaaacaauuucuuucacuacaaccaaaaggaugacccuaaaaugcguaucgucgcgauguuauauaccccacugagaagcaauggcuccggggaugacguguucacagugucuugcaggguccuuacccggcccucgccggauuuugacuucacuuacuugguuccucccacaguggaaucaaagaccaaaccauuuacgcugccuauacuaacucucggagagcugagcaacagucgcuuccccguauccaucgaucagauguauaccucuccaaacgaggugauuagcguccagugucagaaugguagaugcacacuugacggcgaacugcaagggacuacccaguugcaggucuccggaaucugugccuuuaagggcgagguuacagcacaucuccacgauaacgaccaccuguacaauauuaccaucacgaacuuaaaugguucacccuucgacccuagugaagauauaccagcuccgcugggggugcccgacuuccagggaagggucuuuggcauuaucagccaacgggauaagcauaacucuccuggccacaaugagccagccaaccgcgggcaugacgcugugguacccacuuauacagcccaguacaccccuaaacucggacagauucaaaucgguacuuggcagacagaugaccuuaccguuucccagccagugaaguucacgcccgucggccugaaugauaccgaacacuuuaaccaguggguggucccgcgauacgcaggggccuugaaucuaaacacaaaucuggcuccuucaguggcgccaguuuuccccggagagagacuccuguuuuucaggagcuauaucccucuuaaaggcgguuacgggaaccccgcaauugacugccuguugccacaagagugggugcagcacuuuuaucaggaagccgcuccuaguaugucugagguagcccucguccgguacauaaaucccgauacuggccgugcacuguucgaagccaaguuacaucgcgcuggauuuaugaccguguccagcaacacaucggccccaguuguggucccggcaaacggcuauuucagauuugacucuugggugaaucaguucuacucccuggcgccuauggggacuggaaacgguaggcggcgaguacaauga

SEQ ID NO: 18069 - RNA, 1629 nt, Artificial Sequence
  derived and/or modified sequence opt3 from VP1,_capsid_protein__Norovirus__BAL60809
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaacuucacccccgugggucuguccgauacagaccauuuuaaucaguggguugugccgcgauaugcaggcgccuugaaccuaaauacuaaccuggcuccuucaguagcgccagucuuccccggggaaagacuccuguuuuucaggagcuacaucccucuuaagggaggcuaugguacccccgcaauugauugccuguugccacaagagugggugcagcacuuuuaccaggaggccgcuccuaguaugucugaaguugcccucgugcgguauaucaaucccgacacagggcgugcacuguucgaggccaaauuacaccgcgcuggcuuuaugacugucuccagcaacaccucggccccagugguagugccggcaaacggauacuucagauuugauucuuggguuaaucaguucuauucccuggcgccuaugggcacagggaacggaaggcggcgaauccaauga

SEQ ID NO: 18070 - RNA, 1629 nt, Artificial Sequence
  derived and/or modified sequence opt3 from VP1,_capsid_protein__Norovirus__BAL60811
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccagucgaaaauuugaguccgcagcagaucacaauguuuccccacguaauuaucgauguucgcacucucgagccugugcugcugccacuccccgacguccgaaacaauuucuuucauuauaaccaaaaggaugacccuaaaaugcguauuguggcgauguuauacaccccacugagaagcaauggcuccggggaugacguguucacagucucuugcaggguucuuacccggcccucgccggauuuugacuucacuuauuuggugccucccacaguagaaucaaagaccaaaccauuuacgcugccuauccuaacucucggagagcugagcaacagucgcuuccccguguccauagaucagauguacaccucuccaaacgaggucaucagcgugcagugucagaaugguagaugcacacuugacggcgaacugcaagggacuacccaguugcagguuuccggaauuugugccuuuaagggcgaggugacagcacaccuccaugauaacgaccaccuguauaauaucaccauuacgaacuuaaaugguucacccuucgacccuagugaagauaucccagcuccgcuggggguccccgacuuccagggaaggguguuuggcauaauuagccaacgggauaagcacaacucuccuggccauaaugagccagccaaccgcgggcacgacgcuguaguucccacuuacacagcccaguacaccccuaaacucggacagauccaaauugguacuuggcagacagaugaccuuaccgugucccagccagucaaguucacgcccgugggccugaaugauaccgaacauuuuaaccagugggucgugccgcgauaugcaggggccuugaaucuaaacacaaaucuggcuccuucaguugcgccaguguuccccggagagagacuccuguuuuucaggagcuacaucccucuuaaaggcgguuauggggaccccgcaaucgauugccuguugccacaagaguggguacagcacuuuuaccaggaagccgcuccuaguaugucugaggucgcccucgugcgguauauuaaccccgacacuggccgugcacuguucgaagccaaguuacaccgcgcuggauuuaugaccguuuccagcaauacaucggccccaguggucgugccggcaaacggcuacuucagauuugauucuuggguaaaccaguucuauucccuggcgccuauggggacuggaaaugguaggcggcgagugcaauga

SEQ ID NO: 18071 - RNA, 1629 nt, Artificial Sequence; identical to SEQ ID NO: 18070
  derived and/or modified sequence opt3 from VP1,_capsid_protein__Norovirus__BAL60813

SEQ ID NO: 18072 - RNA, 1629 nt, Artificial Sequence; identical to SEQ ID NO: 18069
  derived and/or modified sequence opt3 from VP1,_capsid_protein__Norovirus__BAL60815

SEQ ID NO: 18073 - RNA, 1629 nt, Artificial Sequence
  derived and/or modified sequence opt3 from VP1,_capsid_protein__Norovirus__BAL60817
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccaaucgaaaauuugaguccgcagcagauuacaauguuuccccacgugaucauugauguacgcacucucgagccuguucugcugccacuccccgacgugcgaaacaauuucuuucauuauaaccaaaaggaugacccuaaaaugcguaucgucgcgauguuauacaccccacugagaagcaauggcuccggggaugacguguucacagugucuugcaggguccuuacccggcccucgccggauuuugacuucacuuauuugguuccucccacaguggaaucaaagaccaaaccauuuacgcugccuauacuaacucucggagagcugagcaacagucgcuuccccguauccaucgaucagauguacaccucuccaaacgaggugauuagcguccagugucagaaugguagaugcacacuugacggcgaacugcaagggacuacccaguugcaggucuccggaaucugugccuuuaagggcgagguuacagcacaccuccaugauaacgaccaccuguauaauauuaccaucacgaacuuaaaugguucacccuucgacccuagugaagauauaccagcuccgcugggggugcccgacuuccagggaagggucuuuggcauuaucagccaacgggauaagcacaacucuccuggccauaaugagccagccaaccgcgggcacgacgcugugguacccacuuacacagcccaguacaccccuaaacucggacagauucaaaucgguacuuggcagacagaugaccuuaccguuucccagccagugaaguucgcacccgucggccugaaugauacggaacauuuuaaccaguggguggucccgcgauaugccggggcuuugaaucuaaacaucaaucuggcgccuucaguggcaccaguuuuccccggagagagacuccuguuuuucaggagcuacauuccucuuaaaggcgguuaugggaaccccgccauagacugccuguugccacaagagugggugcagcacuuuuaccaggaagcugccccuaguaugucugagguagcacucguccgguauaucaaucccgauaccggccgugcccuguucgaagcuaaguuacaccgcgccggauuuaugacaguguccagcaacacuucggcaccaguuguggucccggcgaacggcuacuucagauuugacucuugggugaaucaguucuauucccuggcuccuauggggaccggaaacgguaggcggcgaguacaauga

SEQ ID NO: 18074 - RNA, 1629 nt, Artificial Sequence; identical to SEQ ID NO: 18055
  derived and/or modified sequence opt3 from VP1,_capsid_protein__Norovirus__BAL60819

SEQ ID NO: 18075 - RNA, 1629 nt, Artificial Sequence; identical to SEQ ID NO: 18055
  derived and/or modified sequence opt3 from VP1,_capsid_protein__Norovirus__BAL60821

SEQ ID NO: 18076 - RNA, 1629 nt, Artificial Sequence
  derived and/or modified sequence opt3 from VP1,_capsid_protein__Norovirus__BAL60823
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggcuugaggugcagguuaugcuggcuggaaacgccuucaccgcaggcaaauugguguuugcugccgugcccccucauuucccaaucgaaaaucucaguccgcagcagauuacaauguuuccccacgucaucauugauguacgcacucuggagccuguucugcucccauuacccgacgugcgaaacaauuucuuucauuauaaccaaaaggaugacccuaaaaugcguaucgucgcgaugcuguacaccccacuuagaagcaauggcuccggggaugacguguucacagugucuugcagggucuugacccggcccucgccggauuuugacuucacuuaucugguuccucccacaguggaaucaaagaccaaaccauuuacgcuaccuauacucacucugggagagcuuagcaacagucgcuuccccguauccaucgaucagauguacaccucuccaaacgaggugauuagcguccagugucagaaugguagaugcacacuggacggcgaauugcaagggacuacccagcuccagguguccggaaucugugccuuuaagggcgagguuacagcacaccuucaugauaacgaccacuuauauaauauuaccaucacgaaccugaaugguucacccuucgacccuagugaagauauaccagcuccgcucggggugcccgacuuccagggaagggucuuuggcauuaucagccaacgggauaagcacaacucuccuggccauaaugagccagccaaccgcgggcacgacgcugugguacccacuuacacagcccaguacaccccuaaacuuggacagauucaaaucgguacuuggcagacagaugaccugaccguuucccagccagugaaguucacgcccgucggcuugaaugauaccgaacauuuuaaccaguggguggucccgcgauaugcaggggcccuaaaucugaacacaaaucucgcuccuucaguggcgccaguuuuccccggagagagacugcuguuuuucaggagcuacaucccucugaaaggcgguuaugggaaccccgcaauugacugcuugcucccacaagagugggugcagcacuuuuaccaggaagccgcuccuaguaugucugagguagcccugguccgguauauaaaucccgauacuggccgugcauuauucgaagccaagcugcaccgcgcuggauuuaugaccguguccagcaacacaucggccccaguuguggucccggcaaacggcuacuucagauuugacucuugggugaaucaguucuauucccuagcgccuauggggacuggaaacgguaggcggcgaguacaauga

SEQ ID NO: 18077 - RNA, 1629 nt, Artificial Sequence
  derived and/or modified sequence opt3 from VP1,_capsid_protein__Norovirus__BAL60825
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaaguuuuacgcugccaauccuaacucucggagagcuguccaacucucgcuucccugugagcauagaucagauguacaccucccccaacgaggucaucucagugcagugucagaaugguagaugcacacuugacggcgaacugcaagggacuacccaguugcagguuaguggaauuugugcguuuaagggcgaggugacagcccaccuccaugauaacgaccaccuguauaaugucaccaucacgaacuuaaaugguagcccauucgaccccucugaagauauuccugcaccacugggggugccggacuuccagggaaggguauuuggcguuaucucccaacgggauaagcacaacacucccggccauaaugagccugcuaaccgcgcccacgacgcuguggucccaacauacaccgcccaguacacucccaaacucgggcagauacaaauuggaacauggcagaccgaugaccuuacggugaaucagccugucaacuucaccccagugggucugucagauacagaccauuuuaaucaguggguugugccccgauaugcaggcgccuugaaccuaaauacuaaccuggcuccgagcguagcgccugucuucccaggggaaagacuccuguuuuucaggaguuacaucccccuuaagggaggcuaugguaccccugcaauugauugccuguugccccaagagugggugcagcacuuuuaccaggaggccgcuccaucuauguccgaaguugcccucgugcgguauaucaauccugacacagggcgugcacuguucgaggccaaauuacaccgcgcuggcuuuaugacugucagcucgaacaccucugcccccgugguagugccagcaaacggauacuucagauuugauuccuggguuaaucaguucuauucacuggcgccgaugggcacagggaacggaaggcggcgaauccaauga

SEQ ID NO: 18078 - RNA, 1629 nt, Artificial Sequence; identical to SEQ ID NO: 18055
  derived and/or modified sequence opt3 from VP1,_capsid_protein__Norovirus__BAL60827

SEQ ID NO: 18079 - RNA, 1629 nt, Artificial Sequence; identical to SEQ ID NO: 18055
  derived and/or modified sequence opt3 from VP1,_capsid_protein__Norovirus__BAL60829

SEQ ID NO: 18080 - RNA, 1629 nt, Artificial Sequence; identical to SEQ ID NO: 18055
  derived and/or modified sequence opt3 from VP1,_capsid_protein__Norovirus__BAL60831

SEQ ID NO: 18081 - RNA, 1629 nt, Artificial Sequence
  derived and/or modified sequence opt3 from VP1,_capsid_protein__Norovirus__BAL60833
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaacuucacccccgugggucugaaugauacagaccauuuuaaccaguggguugugccgcgauaugcaggcgccuugaaucuaaacacuaaucuggcuccuuccguagcgccagucuuccccggggaaagacuccuguuuuucaggucauacaucccucuuaagggaggcuaugguacccccgcaauugauugccuguugccacaagagugggugcagcacuuuuaccaggaggccgcuccuagcaugagugaaguugcccucgugcgguauaucaaccccgacacagggcgugcacuguucgaggccaaauuacaccgcgcuggcuuuaugacugucucuuccaacaccagcgccccagugguagugccggcaaauggauacuucagauuugauucguggguuaaccaguucuauucucuggcgccuaugggcacagggaauggaaggcggcgaauccaauga

SEQ ID NO: 18082 - RNA, 1629 nt, Artificial Sequence
  derived and/or modified sequence opt3 from VP1,_capsid_protein__Norovirus__BAL60835
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagcaaacuucacccccgucggucuguccgauacagaccauuuuaaucagugggugguuccgcgauaugccggcgcuuugaaccuaaauacuaaccuggcgccuucaguggcaccaguauuccccggggaaagacuccuguuuuucaggagcuacaucccucuuaagggaggcuaugguacccccgccauugauugccuguugccacaagaguggguccagcacuuuuaccaggaggcugccccuaguaugucugaaguggcacucguucgguauaucaaucccgacacagggcgugcccuguucgaggcuaaauuacaccgcgccggcuuuaugacuguguccagcaacaccucggcaccagucgugguaccggcgaacggauacuucagauuugauucuugggugaaucaguucuauucccuggcuccuaugggcacagggaacggaaggcggcgaauccaauga

SEQ ID NO: 18083 - RNA, 1629 nt, Artificial Sequence; identical to SEQ ID NO: 18069
  derived and/or modified sequence opt3 from VP1,_capsid_protein__Norovirus__BAL60837

SEQ ID NO: 18084 - RNA, 1629 nt, Artificial Sequence; identical to SEQ ID NO: 18069
  derived and/or modified sequence opt3 from VP1,_capsid_protein__Norovirus__BAL60839

SEQ ID NO: 18085 - RNA, 1629 nt, Artificial Sequence
  derived and/or modified sequence opt3 from VP1,_capsid_protein__Norovirus__BAL60841
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaaguucacccccgugggucugaacgauacagaccauuuuaaucaguggguugugccgcgauaugcaggcgccuugaaccuaaauacuaaccuggcuccuuccguagcgccagucuuccccggggaaagacuccuguuuuucaggucauacaucccucuuaaaggaggcuaugguaccagcgcaauugauugccuguugccccaagagugggugcagcacuuuuaccaggaggccgcuccaaguaugucugaaguugcccucgugcgguauaucaauccugacacagggcgugcacuguucgaggccaaguuacaccgcgcuggcuuuaugacugucuccagcaacaccucggcccccgugguagugccagcaaacggauacuucagauuugauucuuggguuaaucaguucuauucccuggcgccgaugggcacagggaacggaaggcggcgaauccaauga

SEQ ID NO: 18086 - RNA, 1629 nt, Artificial Sequence; identical to SEQ ID NO: 18055
  derived and/or modified sequence opt3 from VP1,_capsid_protein__Norovirus__BAL60843

SEQ ID NO: 18087 - RNA, 1629 nt, Artificial Sequence; identical to SEQ ID NO: 18081
  derived and/or modified sequence opt3 from VP1,_capsid_protein__Norovirus__BAL60845

SEQ ID NO: 18088 - RNA, 1629 nt, Artificial Sequence; identical to SEQ ID NO: 18069
  derived and/or modified sequence opt3 from VP1,_capsid_protein__Norovirus__BAL60847

SEQ ID NO: 18089 - RNA, 1629 nt, Artificial Sequence
  derived and/or modified sequence opt3 from VP1,_capsid_protein__Norovirus__BAL60849
augaagauggccagcaacgacgcugcacccuccaccgauggcgccgcggggcuggugccugagucuaauucagaagucauggcucucgagccaguugccggagcagcccuugcugcaccggugacaggucagacuaacaucauugaccccuggauaagagccaauuucguacaagcuccuaacggcgaauuuacggugaguccaaggaaugcccccggggagguccuguugaacuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccaaucgaaaacuugagcccgcagcagauuacaauguuuccccacgugaucauugauguacgcacucucgagccuguucugcugccacuccccgacgugcgaaauaacuucuuucauuauaaucaaaaggaugacccuaaaaugcguaucgucgcgauguuauacaccccacugagauccaacggcucuggggaugacguguucacagugucgugcaggguccuuacccggcccucaccggauuuugacuucacuuauuugguuccucccacaguggaaagcaagaccaaaccauuuacgcugccuauacuaacucucggagagcugaguaauucccgcuuccccguaucuaucgaucagauguacaccagcccaaacgaggugauuuccguccagugucagaacgguagaugcacacuugacggcgaacugcaagggacuacccaguugcaggucucaggaaucugugccuuuaagggcgagguuacagcacaccuccaugauaaugaccaccuguauaacauuaccaucacgaauuuaaacgguagucccuucgacccuagcgaagauauaccagcuccgcugggggugcccgacuuccagggaagggucuuuggcauuaucucucaacgggauaagcacaauuccccuggccauaacgagccagccaaucgcgggcacgacgcugugguacccacuuacacagcccaguacaccccuaaacucggacagauucaaaucgguacuuggcagacagaugaccuuaccguuucacagccagugaaguucacgcccgucggccugaacgauaccgaacauuuuaaucaguggguggucccgcgauaugcaggggccuugaaccuaaauacaaaccuggcuccuagcguggcgccaguuuuccccggagagagacuccuguuuuucaggaguuacaucccucuuaaaggcgguuaugggaaucccgcaauugacugccuguugccacaagagugggugcagcacuuuuaccaggaagccgcuccuucuauguccgagguagcccucguccgguauauaaaccccgauacuggccgugcacuguucgaagccaaguuacaccgcgcuggauuuaugaccgugagcucgaauacaucugccccaguuguggucccggcaaacggcuacuucagauuugacuccugggugaaccaguucuauucacuggcgccuauggggacuggaaaugguaggcggcgaguacaauga

SEQ ID NO: 18090 - RNA, 1629 nt, Artificial Sequence; identical to SEQ ID NO: 18055
  derived and/or modified sequence opt3 from VP1,_capsid_protein__Norovirus__BAL60851

SEQ ID NO: 18091 - RNA, 1647 nt, Artificial Sequence
  derived and/or modified sequence opt3 from VP1__Norovirus__AAT00378
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugauugcgaugcuguacacaccccucagagccaauaacucuggagacgauguuuucacugugucguguagggucuuaacccggccuucaccagacuuuagcuucaauuuucuggugcccccgacaguggaaaguaagaccaaaccuuucacucuucccaucuugacaauauccgagaugucuaacagccgcuuuccagucccuauugauucccugcauaccucacccacggaaaauaucguugugcagugccagaacgguagaguaacucuagacggcgagcucauggggaccacacaacugcuuccaagucagauuugugcauucaggggagugcugacucggagcaccucucgcgcuuccgaucaggccgacacagucacgccccgauuguucaauuauuacuggcacauccagcucgacaaccugaauggcaccccuuaugauccagcugaggacaucccgggucccuuagggacuccugauuuuagaggaaagguguucggcguugccucacaaaggaacccagacagcacaacccgggcacaugaagccaaaguggauacuacagcuggccguuuuacccccaagcuggggagucucgagauuucuacggaauccgacgauuucgaccagaaucagccuacccgcuuugcgccagucggaauagguguggauagagaggcaggcuuccaacaguggagccuucccgacuacucggggcaguuuucuaggaucaugucccuggccccggcuguagccccuauuuucccaggagaacaguugcuauuuuuccggucacaacugcccaguagcggcggucgauccaacgggauccucgauugccugguuccucaggagugggugcagcacuuuuaccaggagucugcacccgcccaaacacaggucgcucuugugcgcuaugucaauccagacacuggcagagugcuguucgaagccaaguugcacaaacucggauuuaugaccauagcaaagaacggcgacagcccuauuacaguucccccaaauggguacuucagguucgagucaugggugaacccguuuuauacucuggcgccuaugggaaccgguaacggccggcgcagaauccaguga

SEQ ID NO: 18092 - RNA, 1626 nt, Artificial Sequence
  derived and/or modified sequence opt3 from VP1__Norovirus__ABD95934
augaagauggccagcaacgacgcugcacccuccaaugauggcgccgcggggcuggugccugagaucaacaccgaaacacucccacuugagccggucgcuggagccgcacuggccgcugcaguuacuggucagucuaauauuauagaccccuggaucagaacgaacuucgugcaagccccuaauggcgaauuuaccguaucaccaaggaacagucccggggagguguuguuaaaucuggaacuaggaccugaucucaacccauaccuggcucaccuuagccggauguauaauggcuacgccgguggggucgaggugcagguucuguuggcgggaaacgcauucacagccggcaaaauucucuuugcugccgugcccccuaauuucccagucgaguuucuguccccggcacagaucacuaugcugccccaucucauuguggacguacgcaccuuagaaccuaucaugauaccacugcccgauguucgaaacacauucuuucacuauaauaaccguccuucugagagaaugaggcuuguggcuauguuguacaccccacugcggucgaauggcucaggggacgaugucuucacugugagcugccgcgugcuaacaagacccaccccggacuuugaguucacguaucucgucccucccaguguugaauccaagacuaaaccauuuucucugccuauccuuaccauuagcgagcugacaaacuccagguuccccgccccaaucgauucauuguuuacugcgcagaacaauaaccucaaugugcaaugucagaacggacggugcacccuggacggugaauuacagggcacaacccagcugcuccccacggggauuugugccuuccgcggaaagaucagugcagauguacaaaauagccaucaggaccgauggcacaugcagcuuacuaaccugaauggcacaccuuucgauccaaccgacgacgugccggcucccuuggguacuccugauuuuacagggcuacuguucggagucgccucucagagaaacgugggcggcaccgggaauaacacgaccagggcucaugagguugugauagccacaacuuccacccaauuugucccaaaacucggaucaauuaauuucgguagcgaaagugaggacuuucagguggggcccccuacaaaguucacuccaguagggaucaagauugaaaccggacacucuuuucggcagugggaucccccgaacuacuccggcgcacugacacuuaauaugaaccuggccccuccaguugcucccaauuucccuggugagcaauugcucuuuuuccguagcaacgugcccugcgcgggcggcgucucggagggaaucaucgacugucuguuaccacaggaauggauucagcacuuuuaucaggagucugcaccuucccaaucagauguggcccugauacgcuacgucaaccccgacaccggcagaacucuauucgaagcuaaacuccauaggacgggguacaucacaguggcccacaguggagauuauccacugguugugccgagcaaugguuacuuucgguucgacuccuggauuaaccaguucuauucucuugcaccuaugggcaccgggaauggacgacgcagaguacaguga

SEQ ID NO: 18093 - RNA, 1623 nt, Artificial Sequence
  derived and/or modified sequence opt3 from VP1__Norovirus__ABG49509
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgacacgcacaauuacacuaugaaccucgcaucccagaauuggaacaauuaugaucccacagaagagauuccugcuccacuggguacccccgacuucguagggaagauccagggaaugcuuacucagacaacccggggcgacggcucaacgcgcgggcauaaggccaccguuaguacaggagaugugcacuuuacuccuaagcuggguagcauccaauucaacaccgacacaaauaacgauuuugaaacuggccagaauaccaaauucacaccagucggggugguccaggacggaaacggcacccaccaaaaugagccccagcaguggguguugccgucuuacuccggucgaacugggcauaacguucaccucgcuccugccguggcaccaacguuucccggcgaacagcuguuauucuuuagaucaacaaugccuggauguagcggcuaccccaacaugaaucuggauugccuccuuccacaagaguggguacagcauuucuaucaggaggccgcuccugcgcagagugacgucgcacuguugagguuugugaaccccgauaccgggcggguucuauucgaauguaagcugcacaaaucuggauacgugacugucgcccacaccggucaacaugaccucgugauuccaccgaauggcuauuuucguuucgauuccuggguaaaccaguucuacacacuggcuccuauggggaauggaaccggccgcagaagggcccuuuga

SEQ ID NO: 18094 - RNA, 1623 nt, Artificial Sequence
  derived and/or modified sequence opt3 from VP1__Norovirus__ABP88833
augaagauggccaccaacgacgcuagccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaaguggaggucauucuagcgggaaacgcauuuacggccggcaaaaucauuuucgcugccgugccuccaaauuuuccgaccgagggccucucccccucucagguaacaauguucccucauaucauaguugacgugcgccagcuggaaccaguccuuaucccccugccugaugugcgaaacaauuuuuaucacuacaaccaaucgaaugacucaacuauuaaguugaucgcaaugcucuauaccccacugcgugcuaacaacgccggggaugacguguucacagucagcugcagaguucugaccaggcccaguccggauuuugacuucauuuuucucgugccucccacuguagagucccggacaaaaccauucaccgugccuaucuuaacggucgaagagaugacuaauucucgcuuucccauaccacuggagaaacuuuucaccggacccagcuccgcguuggugguucagccucagaacgguagauguacaacugauggcgugcugcuagggaccacacagcucucaccagucaauauuugcaccuucaggggagacgugacgcauaucaguggcacucggacauaccgcaugaaccuggccagccaaaauuggaacaauuaugauccgaccgaagagauucccgcaccucuugguacuccagacuuuguagggaagauccagggaaugcugacacagaccacgaagggcgacggcucuacccgagggcacaaggcuacaguuuccacuggaucaguggauuucacccccaaauuggguagcguccaguuugccacagacacugauaacgacuucgaaaccggccaaaauacaagauuuaccccugugggggucauccaggauggaaguucugcucauaggaacgagccacagcaaugggugcuccccgacuacuccggccggacuguucacaaugugcaccuggccccggcaguagccccuacguucccaggugaacaguuacccuuuuuccguagcacaaugccuggguguucgggcuaccccaacauggaucuggacugccuccuuccacaggaguggguccagcauuuuuaucaagaggcugcgccuucucaguccgauguggcacuguugcgcuucguuaaucccgacaccggaagagugcuauuugaauguaagcugcacaaagccggcuacgucacuguggcucauaccgggcagcacgaucucguaauuccaccgaacggauauuucagguuugacucaugggugaaucagaguuacacacuggccccuauggguaacggcgcagggcggcgacgcgcccuuuga

SEQ ID NO: 18095 - RNA, 1623 nt, Artificial Sequence
  derived and/or modified sequence opt3 from VP1__Norovirus__ABY27560
augaagauggccagcuccgacgcuucucccucagauggcaguaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucacagugcccaucuuaaccgucgaggaaaugacgaacagccgcuuuccaauaccccuggagaaacuuuucacuggaccuuccggugcguucgugguucagccacagaauggcagauguaccacagaugggguguugcugggaacuacccaacuaucaccggucaacauuugcacauuuaggggcgacgugacccauaucgccgguacgcacgauuacacuaugaaucucgcaagucagaacuggaauaacuaugaccccacagaggaaauuccugcuccacuggggacccccgacuucguaggaaagauccagggcguucuuacucagacaacccggggcgaugggagcacgcgcggacauaaggccaccgugucuacagguuccguccacuuuacuccuaagcugggcucagugcaauucaccacagacacuaauaacgauuuggagaccgggcagaauacaaaauuuaccccagucggagugguucaggacggcaacagcgcucaccaaaaugaaccccagcagugggugcucccgaacuacaguggucgaacugggcauaauguacaccuggccccugcagucgccccaacguuccccggcgagcaguuacuguuuuucagaucuacaaugccuggauguuccggcuaccccaacaugaaucucgauugccuucugccacaagaauggguguugcauuuuuaucaggaggcugcgccugcacagagcgacguugcccuacugagguucgugaaccccgauaccgggcggguccucuuugaguguaagcugcacaaaucgggauacgugacuguagcucacaccgguccacaugaccuugugaucccgccuaacggcuauuuccguuuugauucuuggguuaaucaguucuacacacuggcccccauggggaacggagcaggccgcagaagggccuuguga

SEQ ID NO: 18096 - RNA, 1620 nt, Artificial Sequence
  derived and/or modified sequence opt3 from VP1__Norovirus__ACT76139
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccaggcacaugacagcaccuugaagcucauugcuaugcuguauacaccacugcgugccaauaacgcgggggaugacguguucacugucaguugcagaguucucaccaggcccuccccggauuuugacuucaucuuuuuagugccucccacaguagaaucucggaccaaaccauucacugugccuauucugacagucgaggaaaugagcaacucccgcuuucccaucccacuugagaaguuguacaccggacccucaagugccuucgugguucagccucagaaugguagauguacgacugauggcgugcugcuagggaccacacaacucagcgcagucaacauaugcaauuucaggggagacgugacucggguaggcauuucucacgauuauaccaugaaccugguuucccagaauuggaacaauuacgacccaacagaggaaaucccggcuccccuugguaccccugacuuuguggggaaaauucagggacuguugacgcagacuacacgcgccgauggcucaacccgagcucauaaggccacugucagcacaggcagugugcacuucaccccaaagcucgggucuguccaauuuacgaccgacacaaacaaugauuuccagacuggacagaacaccaaauuuacacccguggguguuauccaagacggcgaucaccaucagaaugagccucagcagugggugcugccaaacuacuccgggacuagcggacacaauguacauuuagcacccgccgucgcuccgaccuucccuggcgaacaacugcucuuuuucagaucgacaaugccagguuguucuggguaucccaacaugaaucuugacugccuguugccucaggagugggugcuacacuuuuaccaggaagcggcacccgcccaguccgauguugcucugcucagguucgugaacccagacaccggccggguccuguuugaguguaaacuucacaagucaggauauaucacuguggcccauacgggcccuuacgaucugguaauucccccaaacggguauuuccguuuugacaguugggugaaucaauucuacacauuggcaccgaugggaaacgguaccggccgcagaagggcccucuga

SEQ ID NO: 18097 - RNA, 1620 nt, Artificial Sequence
  derived and/or modified sequence opt3 from VP1__Norovirus__ACT76142
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacaucauagaccccuggaucagaaauaacuucguccaggcuccugguggcgaauuuacagugaguccaaggaaugcacccggggagauucuuuggagcgccccucuguccccagauuugaaccccuacuuaucucaccugucgcggauguauaauggauacgcuggcgguuucgaaguucaggugauccuagccgggaacgcguuuacugcaggaaaaauuaucuucgccgcuauaccuccaaauuuuccgacggagggccucucacccagccaggucaccauguucccucauaucauuguggacguacgccaacuggagccaguucuuaucccccugccugaugugcgaaacaauuuuuaucacuacaaccaggcccaugacaguacauugaagcucauugcaaugcuguauacuccacugcgugcuaauaacgccggcgaugacgucuucaccguguccugcagagugcucacaaggcccucuccggauuuugacuucaucuuuuuagucccucccaccguugaaagccggacuaaaccauucacagugccuauacugaccguagaggaaauguccaacucacgcuuucccauuccacuugagaaguuguacacggggcccaguagcgcguucgugguccagccucagaauggaagauguacuaccgauggugugcugcuaggcacaacucaacucucugccguuaacaucugcaauuucaggggagacgugacccgggucgggauuucccacgauuauacaaugaaccuggugucacagaauuggaacaauuacgacccaaccgaggaaaucccggcaccccuuggcacgccugacuuuguagguaaaauccaggggcuguugacucagacaacccgcgcugauggaagcacucgagcccauaaggcuacaguuaguaccggcucugugcacuucacgccaaagcucggcuccguccaauuuaccacagacacuaacaaugauuuccagaccgggcagaacacaaaauuuacucccgugggagucauucaagacggugaucaccaucagaaugagccucagcagugggugcugccaaacuacagcggcaccucggggcacaauguucauuuagcccccgcaguggccccgacauucccuggagaacaacugcucuuuuucagaucuaccaugccaggcuguuccgguuaucccaacaugaaucuugacugccuguugccucaggaguggguaucacacuuuuaccaggaagcugcgcccgcacagagugaugucgcccuacugagguucgugaacccagacacugggcggguucucuuugaguguaagcugcacaaaagcggcuauauaacgguggcucauacaggaccuuacgaucuugucauucccccaaacggcuauuuccguuuugacuccugggugaaucaauucuacacccuggccccgauggggaacggaucuggucgcaagagaguauuguga

SEQ ID NO: 18098 - RNA, 1620 nt, Artificial Sequence
  derived and/or modified sequence opt3 from VP1__Norovirus__ACT76145
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccagagccaugacaguaccuugaagcucauugcaaugcuguauacaccacugcgugcuaauaacgccggggaugacguguucacugucuccugcagaguucucaccaggcccucuccggauuuugacuucaucuuuuuagugccucccacaguagaaagccggaccaaaccauucacugugccuauucugacagucgaggaaauguccaacucacgcuuucccaucccacuugagaaguuguacaccggacccaguagcgcguucgugguucagccucagaaugguagauguacgacugauggcgugcugcuagggaccacacaacucucugccgucaacauaugcaauuucaggggagacgugacucacauuguaggcucccaugauuauaccaugaaccugguuucacagaauuggagcaacuacgacccaacagaggaaaucccggcaccccuugguaccccugacuuuguggggaaaauucagggacuguugacgcagacuacacgggcugauggcaguacccgcgcccacaaggcuacugucucuacaggcuccgugcacuucaccccaaagcucgggagcguccaauuuacgaccgacacaaauaacgauuuccagacuggacagaauaccaaauuuacacccguggguguuauccaagacggcgaucaucaccagaacgagccucagcagugggugcugccaaauuacucggggcgaacuggacauaacguacacuuagcccccgcagucgccccgaccuucccuggcgaacaacugcucuuuuucagaucuacaaugccagguuguuccggguaucccaauaugaaccuugacugccuguugccucaggagugggugcuacacuuuuaccaggaagcugcgcccgcacagucagauguugcccugcucagguucgugaauccagacaccggccggguccuguuugaguguaaacuucauaagaguggauauaucacuguggcucacacgggcccuuacgaucugguaauucccccaaacggguauuuccguuuugacagcugggugaaccaauucuacacauuggccccgaugggaaaugguaccggccgcagaagggcacucuga

SEQ ID NO: 18099 - RNA, 1620 nt, Artificial Sequence
  derived and/or modified sequence opt3 from VP1__Norovirus__ACT76148
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccugucccggauguauaacggcuacgccgguggguucgaagugcaggucauucuagcgggaaaugcauuuacagccggcaaagugaucuucgcugccguaccuccaaacuuuccgacugagggccucucucccucgcagguuacgauguucccucauauuaucguggacguccgccaacuggagccagugcuuauaccccugccugaugugcgaaauaacuuuuaucacuacaaucaggcacaugacucaaccuugaagcucaucgcuaugcuguauacaccacugcgugccaacaacgcgggggaugacgucuucacuguuagcugcagagugcucaccaggcccaguccggauuuugacuucaucuuuuuaguaccucccacaguggaaucccggaccaaaccauucacugucccuauucugacaguggaggaaaugucuaauagccgcuuucccauuccacuugagaaguuguacaccggacccuccucagccuucguugugcagccucagaacgguagauguacgacugauggcguccugcuagggaccacacaacucagugcagugaauaucugcaacuucaggggagacguaacucacauaguuggcagccaugauuauaccaugaaucuggugucucagaacugguccaauuacgacccaacagaggaaauuccggcuccccuugguaccccugacuuugucgggaaaauccagggacuguugacgcagacuacacgggccgauggcucaacccgcgcucacaaggccacugugagcacaggcaguguccacuucauuccaaagcucgggucugugcaauuuaccacggacaccaacaaugauuuccagacaggacagaacacuaaauuuacccccguuggugugauccaagacggcgaucaucaccagaaugagccucagcaguggguacugccaaacuacuccgggcgaacaggacauaauguccacuuagcacccgccguggcuccgacuuucccuggcgaacaacugcucuuuuucagaagcaccguuccagguuguucgggguaucccaacaugaaucuugacugccuguugccucaggagugggugucucacuuuuaccaggaagcggcacccgcccaguccgaugucgcucuacugagguucgugaacccagacacaggccggguacucuuugaguguaagcugcauaaaucaggauauaucaccguggcccacacuggcccuuacgaucuuguucugcccccaaacggguauuuccguuuugacaguugggucaaucaauucuacacguuggcaccgaugggaaacgguacaggccgcagaagggcccucuga

SEQ ID NO: 18100 - RNA, 1620 nt, Artificial Sequence
  derived and/or modified sequence opt3 from VP1__Norovirus__ACT76151
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccugucucggauguauaauggcuacgccgguggguucgaagugcaggucauucuagcgggaaacgcauuuacagccggcaaagugaucuucgcugccguaccuccaaauuuuccgacugagggccucucgcccucacagguuacgauguucccucauauuaucguggacguccgccaacuggagccagugcuuauaccccugccugaugugcgaaacaauuuuuaucacuacaaccaggcacaugacagcaccuugaagcucaucgcuaugcuguauacaccacugcgugccaauaacgcgggggaugacgucuucacuguuaguugcagagugcucaccaggcccuccccggauuuugacuucaucuuuuuaguaccucccacaguggaaucucggaccaaaccauucacugucccuauccugacaguggaggaaaugagcaacucccgcuuucccauuccacuugagaaguuguacaccggacccucaagugccuucguugugcagccucagaaugguagauguacgacugauggcguccugcuagggaccacacaacucagcgcagugaacaucugcaauuucaggggagacguaacucggguuggcauaucucacgauuauaccaugaaccuggugucccagaauuggaacaauuacgacccaacagaggaaauuccggcuccccuugguaccccugacuuugucgggaaaauccagggacuguugacgcagacuacacgcgccgauggcucaacccgagcucauaaggccacugugagcacaggcaguguccacuucaccccaaagcucgggucugugcaauuuacgaccgacacaaacaaugauuuccagacuggacagaacaccaaauuuacacccguuggugugauucaagacggcgaucaccaucagaaugagccucagcaguggguacugccaaacuacuccgggacuagcggacacaauguccauuuagcacccgccguggcuccgaccuucccuggcgaacaacugcucuuuuucagaucgacaaugccagguuguucuggguaucccaacaugaaucuugacugccuguugccucaggaguggguucuacacuuuuaccaggaagcggcacccgcccaguccgauguggcucugcucagguucgucaacccagacaccggccgggugcuguuugaguguaaacuucacaagucaggauauaucacuguagcccauacgggcccuuacgaucuggugauucccccaaacggguauuuccguuuugacaguuggguuaaucaauucuacacauuggcaccgaugggaaacgguaccggccgcagaagggcccucuga

SEQ ID NO: 18101 - RNA, 1623 nt, Artificial Sequence
  derived and/or modified sequence opt3 from VP1__Norovirus__ACX31821
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggaacaauuacgauccgacugaggaaauucccgccccucuggguacaccagacuuuguagggaagauccagggaaugcuuacccagacuacacgaagcgacggcucuaccagaggccacaaagcuacgguuuucaccggguccgccgauuuugcacccaagcugggaagggugcaauucgccacagacacugauaacgacuuugagucaggucagaauaccaaguucacaccugucggcgugauccaggaugggagcacuacccaucggaacgaaccacaacagugggucuugcccaauuacaguggacguacaggccacaacgugcaccucgcuccggcgguugcaccuaccuauccaggugagcagcuguuauuuuuccgcucuacuaugcccggguguuccggcuacccuaauauggaccuggauugccuccuuccccaggaaugggugcaacauuuuuaucaggaggccgcuccagcccagagcgacguagcacuguugagauucgucaacccugauacgggaagggugcuauuugaguguaaacugcacaagucgggcuacguuacaguggcccauaccgggcagcacgaccucgucauucccccaaacggauauuuccgguuugauucuugggugaaucaauucuacacucuggcuccgauggguaacggcaccgggcgacgcagagcccuuuga

SEQ ID NO: 18102 - RNA, 1623 nt, Artificial Sequence
  derived and/or modified sequence opt3 from VP1__Norovirus__ACX31837
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugagacccaucaaaacacaaaguucacuccagugggggucauccaggacggaaguaccacacaccgaaaugaaccccagcaaugggugcucccgucuuacuccggcagaaacguucacaaugugcaucuggccccugcaguagcuccaaccuuucccggugagcaguuacuguucuuuaggagcacuaugccuggguguucgggcuaucccaacauggaucucgacugccuucugccacaggaguggguccagcacuucuaccaagaagcggccccugcacagucugauguggcuuugcuacgguuuguuaaucccgacacgggacgugugcuguucgaguguaaacuccauaaguccggcuaugucacaguggcccacaccgggcagcacgaucugguaauuccaccgaacggauacuuucgcuucgacucaugggugaaccaguucuauacucuugcaccuauggguaauggcaccgggagaaggcgggcccuguga

SEQ ID NO: 18103 - RNA, 1623 nt, Artificial Sequence
  derived and/or modified sequence opt3 from VP1__Norovirus__ACX31841
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccacccccuuuacaccuaaauugggcucaguccaguucagcacugacaccgaaaaugauuuugagacacaucaaaacacuaaguucaccccagugggggucauccaggacggaaguacaacccaccgaaaugaaccccagcaaugggugcucccgucuuacuccggcagagauguucacaacgugcaucuggccccugcaguagccccaacuuuucccggugagcaguuacuguucuuuaggagcacgaugccuggguguucgggcuaucccaauauggaccucgauugccuucugccacaggaguggguccagcacuucuaccaagaagcugcgccugcacagucugacguggccuugcuacgguuuguuaaccccgauacaggacgugugcuguucgaguguaaacuccauaaguccggcuaugucaccguggcucacacugggcagcacgaccugguaauuccaccgaauggauacuuucgcuucgauucaugggugaaccaguucuauacccuugccccuauggguaacggcacagggagaaggcgggcacuguga

SEQ ID NO: 18104 - RNA, 1623 nt, Artificial Sequence
  derived and/or modified sequence opt3 from VP1__Norovirus__ACX31851
augaagauggccagcaacgacgcuaaucccuccaacggcucugcagccaaucuggugccugaggucaacaaugaaguuauggcgcucgagccagugguaggggcugccaucgcagccccgguggcuggacagcaaaacgucauugaucccuggauaagaaauaacuucgugcaggcaccugguggcgaauuuaccguuucaccaaggaaugcccccggggagauccuuuggagugcuccucugggaccagacuugaaccccuacuuaagccaccuggcccggauguauaauggcuacgcggguggguucgaagugcaggucauucuagcaggaaacgccuuuacagcuggcaaaaucauuuucgccgcagugccuccaaauuuuccgacugagggccucucccccucucagguaacgauguucccucauaucauaguugaugugcgccaacuggagccaguccuuaucccccugccugacgugcgaaacaauuuuuaucacuacaaccagucgaacgauucaaccauuaaguugaucgcuaugcucuauacaccacugcgugccaauaacgcgggggaagacguguucacugucagcugcagaguucugaccaggcccaguccggauuuugacuucauuuuucucgugccucccacaguagagucccggaccaaaccauucacugugccuaucuuaacagucgaagagaugaccaauucucgcuuucccauaccacuggagaaacuuuucacgggacccagcuccgccuucgugguucagccucagaacgguagauguacuaccgauggcguguugcuggggacaacucaacuaucaccagucaauauuugcaccuuuaggggagacgugacacauaucgcaggcagucggaacuacaccaugaaucucgcuagccugaacuggaauaacuaugauccgacggaagagauucccgccccucuugguacuccagacuucguagggaagauccagggaguucugacacagaccacuaagggcgauggcucuacacgcgggcacaaggcuaccguguacacgggauccgcccccuuuaccccuaaauuggguucaguccaguucagcacagacacugaaaaugacuuugagacccaucaaaacacaaaguucacuccagugggcgucauccaggaugggggaaccacacaccgaaaugaaccccagcaaugggugcucccgaguuacucuggcagaaacguuccuaaugugcaccuggcaccagccguagcucccaccuuuccuggugagcaguuacuguucuuuagguccacuaugcccggguguagcggcuauccaaacauggaccucgauugccuucugccucaggaguggguccagcauuucuaccaagaagcggcacccgcccagucggacguggcuuugcuacgguuuguuaacccagauacgggacgugugcuguucgaguguaaacuccacaagucuggcuaugucacaguggcccauaccgggcagcacgaccugguaauuccgccuaauggauacuuucgcuucgauuccugggugaaccaguucuauacucuugcacccauggguaauggcaccgggagaaggcgggcccuguga

SEQ ID NO: 18105 - RNA, 1623 nt, Artificial Sequence
  derived and/or modified sequence opt3 from VP1__Norovirus__ACX31856
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugaggcacaucaaaauaccaaguucacaccagugggcgucauccaggacgggggaacuacccaccgaaacgaaccccagcaaugggugcucccgaguuacucuggcagaaauguuccuaacgugcaccuggccccagcuguagcgcccacauuuccuggugagcaguuacuguucuuuagguccaccaugcccggguguagcggcuauccaaauauggaucucgacugccuucugccucaggaguggguccagcauuucuaccaagaagcagcccccgcucagucggauguggccuugcuacgguuuguuaacccagacacuggacgugugcuguucgaguguaaacuccacaagucuggcuaugucacgguggcacauacagggcagcacgaucugguaauuccguccaacggauacuuucgcuucgacucaugggugaaucaguucuauacccuugccccuauggguaacggcacugggagaaggcggguucuguga

SEQ ID NO: 18106 - RNA, 1623 nt, Artificial Sequence
  derived and/or modified sequence opt3 from VP1__Norovirus__ACX31860
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcggugccuucgugguucagccucagaauggcagauguacuaccgaugggguguugcugggaacaacucaacuauccccagucaacauuugcaccuuuaggggcgacgugacacauaucgcagguucacgggauuacaccaugaaucucgcuagucugaacuggaauaacuaugacccgacggaggaaauucccgccccucuugggacuccagacuucguaggaaagauccagggcguucugacacagaccacugagggcgaugggagcacacgcggacacaaggcuaccguguacacggguucugcccccuuuaccccuaaguugggcuccguccaguucucaacagacacugaaaaugauuuugagacccaucaaaacacaaaauucacuccagugggggucauccaggacggaagcaccacacaccgaaaugaaccccagcaaugggugcucccgaguuacucuggcagaaacguucacaaugugcaucuggccccugcaguagcuccaaccuuucccggugagcaguuacuguucuuuagguccacuaugccuggguguagcggcuaucccaacauggaucucgacugccuucugccacaggaguggguccagcacuucuaccaagaagcggccccugcacagucggauguggcuuugcuacgguuuguuaaucccgacacgggacgugugcuguucgaguguaagcuccauaaaucuggcuaugucacaguggcccacaccgggcagcacgaucugguaauuccaccgaacggauacuuucgcuucgacuccugggugaaccaguucuauacucuugcaccuauggguaauggcaccgggagaaggcgggcccuguga

SEQ ID NO: 18107 - RNA, 1623 nt, Artificial Sequence
  derived and/or modified sequence opt3 from VP1__Norovirus__ACX31864
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauaugaaccccuacuugucccacuuagcucggauguauaauggcuacgccgguggguucgaagugcaggucauucuggcgggaaacgcauuuacugccggcaaaaucauuuucgcugccgugccuccaaauuuuccgacggagggccuaucucccucgcagguaaccauguucccucauaucauaguugacgugcgccaacucgagccaguccugaucccccuuccugaugugcgaaacaauuuuuaucacuacaaccagucaaaugacccaacaauuaagcugaucgcaauguuguauacuccccuccgugcuaacaacgccggggaugacguguucaccgucagcugcagaguucugacaaggccgaguccugauuuugacuucauuuuucuggugcccccaaccguagaaucccggacuaaaccuuucucugugcccauccucacagucgaggaaaugaccaauagccgcuuuccaauacccuuagagaagcuguucacgggaccuuccucagcguucgugguucagccacagaacgguagauguacuaccgauggcgugcuuuuggggacaacucaacugaguccggucaauauuugcaccuuuaggggagacgugacacauaucgccggcagccggaacuacaccaugaaucuagcaucucagaacuggaacuccuaugaucccacggaggaaauuccugcuccacucgguacucccgacuucguagggaaaauccagggaguucugacacagaccacucgcacagacggcucaacccgaggccacaaggccacgguguacaccgggagcgcugauuuuaguccuaaacuuggaagaguccaauucgccacagacacugauaaugacuuuguggcaaaucagaacaccaaguucacaccagucggugugauccaggauggcaauacugcccauaggaacgagccccaacaguggguucugccgucuuacuccgggcggaauacccacaacgugcacuuggcuccugcgguagcaccaacauuucccggagaacagcuccuguucuuucguagcaccaugccuggcuguucggguuaucccaauauggacuuagauugccugcucccacaggaguggguccaauacuucuaucaggaagccgcuccugcccagucugacguggcacuucugcgcuuuguuaaccccgauacugggagaguguuguucgaguguaagcuacauaaauccggcuacgucacgguggcccacacaggacagcaugaccugguaauuccaccgaacggcuauuuuagguucgauucaugggugaaucaauucuacacccucgcuccuauggggaacggaacuggucggcgacgcgcccuguga

SEQ ID NO: 18108 - RNA, 1623 nt, Artificial Sequence
  derived and/or modified sequence opt3 from VP1__Norovirus__ACX31889
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauaugaaccccuacuugucccacuuagcucggauguauaauggcuacgccgguggguucgaagugcaggucauucuggcgggaaacgcauuuacugccggcaaaaucauuuucgcugccgugccuccaaauuuuccgacggagggccuaucucccucgcagguaaccauguucccucauaucauaguugacgugcgccaacucgagccaguccugaucccccuuccugaugugcgaaacaauuuuuaucacuacaaccagucaaaugacccaacaauuaagcugaucgcaauguuguauacuccccuccgugcuaacaacgccggggaugacguguucaccgucagcugcagaguucugacaaggccgaguccugauuuugacuucauuuuucuggugcccccaaccguagaaucccggacuaaaccuuucucugugcccauccucacagucgaggaaaugaccaauagccgcuuuccaauacccuuagagaagcuguucacgggaccuuccucagcguucgugguucagccacagaacgguagauguacuaccgauggcgugcuuuuggggacaacucaacugaguccggucaauauuugcaccuuuaggggagacgugacacauaucgccggcagccggaacuacaccaugaaucuagcaucucagaacuggaacuccuaugaucccacggaggaaauuccugcuccacucgguacucccgacuucguagggaaaauccagggaguucugacacagaccacucgcacagacggcucaacccgaggccacaaggccacgguguacaccgggagcgcugauuuuaguccuaaacuuggaagaguccaauucgccacagacacugauaaugacuuugaugcaaaucagaacaccaaguucacaccagugggugucauccaggacggcaauacugcccauaggaacgagccccaacagugggugcugccgucuuacuccgggcggaauacccacaacguucacuuggcuccugcgguggcaccaacauuucccggagaacagcuccuguucuuucguagcaccaugccuggcuguucggguuaucccaauauggauuuagacugccugcucccacaggaguggguacaauacuucuaucaggaagccgcuccugcccagucugaugucgcacuucugcgcuuugugaaccccgacacugggagaguuuuguucgaguguaagcuacauaaauccggcuacgugacggucgcccacacaggacagcaugaucuggugauuccaccgaacggcuauuuuagguucgacucauggguaaaucaauucuacacccucgcuccuauggggaacggaacuggucggcgacgcgcccuguga

SEQ ID NO: 18109 - RNA, 1608 nt, Artificial Sequence
  derived and/or modified sequence opt3 from VP1__Norovirus__ACX31893
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggaggucuuguuaaaucuggaacuaggaccugagcucaacccauaccuggcccaccuuagccggauguauaauggcuacgcuggugggguggagguucaggugcuguuggccggaaacgcguucacggcaggcaaacucgucuuugccgcugugcccccucauuucccacuggaaaauaucuccccgggccagauuaccauguuuccccacguaaucauugauguucgcacacuggagccugugcucuuaccacugcccgacguccgaaacaauuucuuucauuauaaccagcaaaacgaacagcguaugagacuuguggccauguuguacacuccucugaggucuaaugggucgggagaugacguguucaccgucucaugccggguucuaacacgcccaagccccgauuuugacuucaacuaucucgugccgccuaccguagagaguaagacuaaacccuuuacacugccaauccuuaccauaggugagcugacuaauuccagauucccugugcccaucgaugaauuguacacgucuccaaacgagagccucgucgugcagccccagaaugggaggugugcacuggacggcgaauuacaaggaaccacacagcugcucccuacugcuauuugcuccuuucggggccgcaucaaccagaagguuucaggugagaaucacguguggaacaugcaggucaccaauauuaacgggacaccauucgauccgaccgaagacgugcccgccccucuuggaacgccagauuucaguggcaaacuguuuggcguauugagccaacgagaccaugacaaugcguguagaucucacgaugccguuaucgcaacuaacuccgcuaaguucacacccaagcuaggggccauacagauuggaaccugggagcaggacgaugugcacaucaaucaaccuacuaaauuuacaccagucggucuguucgagucagaaggcuuuaaccaguggacccuccccaauuauagcggggcucugacgcuuaacaugggacuggccccgccuguggcaccaaccuuccccggcgagcagauuuuguuuuucaggagucauaucccucucaaggguggggucgccgaccccgugaucgauugccuguuaccacaggaauggauucaacaccuguaccaggagucugcuccuucccagacagacguugcgcuaauacgguuuacuaaccccgauaccggccguguacucuucgaagcaaaacugcaucgcagcggauacaucacaguggccaauacuggcucgagaccaauugucgugccggcuaacggguauuuuagguucgacucuuggguuaaucaguuuuacucccuugccccuaugggaaccgguaacggccggcgacgcgugcaauga

SEQ ID NO: 18110 - RNA, 1749 nt, Artificial Sequence
  derived and/or modified sequence opt3 from VP1__Norovirus__ACX69259
augaagauggccagcaacgacgcugcacccccuuccucugauggcgccgcgaaucuggugccagagaucaacaaugaagucauggcucucgagccgguugccggggcacagcuugccgcucccguggcaggacaauucaacgccauugacccuuggauaagacagaauuuuguacaggcuccagaaggugaguucaccgugucacccaggaacgccccuggcgaaauccuguugaauuuagagcuggggccacaccuaaaccccuuucuccagcaucuggcgcaaauguacaaugcauaugccggaggcauggagguccaggugguucuugcugguaacgccuucacagcagggaaaauuaucuuugcugccauuccuccacacuucccgcccgaacggcugagugcggcccaggcaacucaguuuccucaugugaucgucgaugugcgccaauuggagccaauaguacucccccugccugacguucgacacaaucuguuccauuuuaaccagcagaaugaugaacguaugcaccucguggcuuucuuauacacgccacugagagccaacagcggaaauggcgacgaugucuuuaccguguccugcagggugcuuacacggcccucucaggacuucgaguuuauguucuuggucccgccuacuguugagaagaaaaccguggcuuucucgcugccccaacuagccguaggcgaaaugucaaacagccgcuggccagcaagaaucacagggaugguggucgauccuaggcucccccaggugcugcacauucagaacggacgguguacccuugacgguacucugaugggcacaacccaauugaauccaaacgauaucugccgcauucgaggguauuuuaguuccucuagacccgagcuccugugugaaggagaggaaagcgagguuaauacgacuccuaccgacuccggcgccacaggugaucagacuccagaggugaggaccgggacacgggcuacccagcguugguucgcggucacggaauuaaacggacagguguacgacccguuuggcgaccaacccgcaccucugggcguaccagauuucaaggcccgcauccucggggcucuuaugagacugcccggaacuaauccuacaucaaacaguagguuugaggacgccuggguugaaaccaauaaccagacuacauaugcaccagccaccgguguggucgcuauaacgaccaaugauaacagcucuggcaauuacgccaacgaccagacaugcgaguucgugcccuuggggauugaaaucacugauuccgcaccguauaaugaguuugaccuaccuucauacggaggcgcggcuagcagugguaaccggaaucuggccccaaccgucgcacccacauucccuggggaggccauucuccuguuuggcucuaacaugcccguguacaaccgauccagcggaacugauaauaaagacauccgcugucuucugccaaacgaauauguucagcauuuguacgauacccaagcuccuucgcucucugacguggcccugguaagauaugucaauagggauacaggccggguguuauucgaggcaaagcugcaccgcgacggguuuaugaccguuaacgcuuccucaacuacggugcuacccgucgacggauacuucagauuugauaguugggugaaucaguucuaugcccucagcccaguagguaacgcguccggcaggcgugggcggucucgacaggccaauuga

SEQ ID NO: 18111 - RNA, 1647 nt, Artificial Sequence
  derived and/or modified sequence opt3 from VP1__Norovirus__ADF47131
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugguugccaugcuguacacaccccucagagcaaauaacucuggagaugacguguucaccgucucguguaggguguuaacucggccuucaccagauuuuagcuucaauuuucuggugcccccgaccgucgagaguaagacaaaaccuuucacccuucccauuuugacuaucuccgaaaugucuaacagccgcuuuccaguuccuauagacucccugcauacaucacccaccgagaauauugugguacagugccagaacgguagagugacgcuagauggcgagcucauggggacuacccaacugcuuccaagucagaucugugcuuucaggggaguccugacacggagcacuucucgcgccuccgaccaggcugauaccgccacaccccgauuguucaauuauuacuggcacauucagcucgacaaccugaauggcaccccuuaugacccagcagaagauaucccgggucccuuagggacgccugacuuuagaggaaagguguucggcguugccucacaaaggaacccagauagcacuacacgggcucaugaggcgaaaguggacaccacugcaggccguuuuacacccaagcuggggagucucgaaaucucuaccgaguccggagauuucaaucagaaccagccuacgcgcuuuaccccagucgguauuggcguggaccacgaagaggauuuccaacaguggagccuucccgacuacucggggcaguuuacacacaauaugaaccuggccccggcuguagccccuaauuucccaggagagcaguugcuauuuuucagaucucaacugcccuccucaggcgguaggaguaacgggauacucgauugccugguuccucaggaaugggugcagcauuuuuaccaggagagcgcacccacucaaacccaggucgcccuugugcgguaugucaacccagacacaggccgagugcuguucgaagcuaaguugcacaaacucggauuuaugacuaucgccaagaauggcgauuccccuauuaccguucccccaaacggguacuuccgcuucgagucuugggugaauccguuuuauacacuggcaccuaccggaacugaaaacgguagaaggcggguacaguga

SEQ ID NO: 18112 - RNA, 1623 nt, Artificial Sequence
  derived and/or modified sequence opt3 from VP1__Norovirus__ADR78869
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuaugucacaguggcccacaccgggcagcacgaucugguaauuccaccgaacggauacuuucgcuucgacuccugggugaaucaguucuauacucuugcaccuauggguaacggcaccgggagaaggcgggcccuguga

SEQ ID NO: 18113 - RNA, 1623 nt, Artificial Sequence
  derived and/or modified sequence opt3 from VP1__Norovirus__ADR78872
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucucagguagucggaauuacaccaugaaccucgcaagccugaauuggaacaauuaugacccgacggaagagauucccgcuccucuugggacuccagauuucguaggaaagauccagggcguucugacacagaccacuaagggcgacgggucuacacgcggacacaaggccaccguguacacggguuccgcucccuuuaccccuaaauugggcucaguccaguucagcacagacacugaaaacgauuuugagacccaucaaaauacaaaguucacuccagugggggucacccaggacggaaguacaacccaccgaaacgaaccccagcaaugggugcucccgucuuacuccggcagaaauguucacaacgugcaucuggccccugcaguagccccaacuuuucccggugagcaguuacuguucuuuaggagcacgaugccuggguguucgggcuaucccaauauggaucucgacugccuucugccacaggaguggguccagcacuucuaccaagaagcugcgccugcacagucugauguggccuugcuacgguuuguuaaccccgacacaggacgugugcuguucgaguguaaacuccauaaguccggcuaugucaccguggcucacacugggcagcacgaucugguaaucccaccgaacggauacuuucgcuucgacucaugggugaaucaguucuauacccuugccccuauggguaacggcacagggagaaggcgggcacuguga

SEQ ID NO: 18114 - RNA, 1623 nt, Artificial Sequence; identical to SEQ ID NO: 18112
  derived and/or modified sequence opt3 from VP1__Norovirus__ADR78875

SEQ ID NO: 18115 - RNA, 1623 nt, Artificial Sequence; identical to SEQ ID NO: 18112
  derived and/or modified sequence opt3 from VP1__Norovirus__ADR78878

SEQ ID NO: 18116 - RNA, 1623 nt, Artificial Sequence; identical to SEQ ID NO: 18112
  derived and/or modified sequence opt3 from VP1__Norovirus__ADR78881

SEQ ID NO: 18117 - RNA, 1623 nt, Artificial Sequence; identical to SEQ ID NO: 18112
  derived and/or modified sequence opt3 from VP1__Norovirus__ADR78884

SEQ ID NO: 18118 - RNA, 1623 nt, Artificial Sequence
  derived and/or modified sequence opt3 from VP1__Norovirus__ADR78887
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugagucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugagacccaucaaaacacaaaguucacuccagugggggucauccaggacggaaguaccacacaccgaaaugaaccccagcaaugggugcucccgucuuacuccggcagaaacguucacaaugugcaucuggccccugcaguagcuccaaccuuucccggugagcaguuacuguucuuuaggagcacuaugccuggguguucgggcuaucccaacauggaucucgacugccuucugccacaggaguggguccagcacuucuaccaagaagcggccccugcacagucugauguggcuuugcuacgguuuguuaaucccgacacgggacgugugcuguucgaguguaaacuccauaaguccggcuaugucacaguggcccacaccgggcagcacgaucugguaauuccaccgaacggauacuuucgcuucgacucaugggugaaccaguucuauacucuugcaccuauggguaauggcaccgggagaaggcgggcccuguga

SEQ ID NO: 18119 - RNA, 1623 nt, Artificial Sequence; identical to SEQ ID NO: 18112
  derived and/or modified sequence opt3 from VP1__Norovirus__ADR78890

SEQ ID NO: 18120 - RNA, 1623 nt, Artificial Sequence; identical to SEQ ID NO: 18112
  derived and/or modified sequence opt3 from VP1__Norovirus__ADR78893

SEQ ID NO: 18121 - RNA, 1623 nt, Artificial Sequence; identical to SEQ ID NO: 18112
  derived and/or modified sequence opt3 from VP1__Norovirus__ADR78896

SEQ ID NO: 18122 - RNA, 1623 nt, Artificial Sequence
  derived and/or modified sequence opt3 from VP1__Norovirus__ADR78899
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuuggggcuccagauuucguaggaaagauccagggcguucugacucagacaaccaagggcgacgggagcacucgcggacacaaggccacaguguacaccgguucugcacccuuuacgccuaaauugggcuccguccaguucucaaccgacacagaaaacgauuuugagacucaucaaaauaccaaguucacaccagugggggucauccaggacggaagcacuacccaccgaaacgaaccccagcaaugggugcucccgaguuacucuggcagaaauguucacaacgugcaucuggccccugcuguagcgccaacauuucccggugagcaguuacuguucuuuagguccaccaugccuggguguagcggcuaucccaauauggaucucgacugccuucugccacaggaguggguccagcacuucuaccaagaagcagccccugcucagucggauguggccuugcuacgguuuguuaaccccgacacuggacgugugcuguucgaguguaaacuccauaagucuggcuaugucacgguggcacacacagggcagcacgaucugguaauuccaccgaacggauacuuucgcuucgacuccugggugaaucaguucuauacccuugccccuauggguaacggcacugggagaaggcgggcucuguga

SEQ ID NO: 18123 - RNA, 1623 nt, Artificial Sequence; identical to SEQ ID NO: 18112
  derived and/or modified sequence opt3 from VP1__Norovirus__ADR78902

SEQ ID NO: 18124 - RNA, 1623 nt, Artificial Sequence; identical to SEQ ID NO: 18112
  derived and/or modified sequence opt3 from VP1__Norovirus__ADR78905

SEQ ID NO: 18125 - RNA, 1623 nt, Artificial Sequence
  derived and/or modified sequence opt3 from VP1__Norovirus__ADR78908
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaauguucacaacgugcaucuggccccugcaguagcuccaaccuuucccggcgagcaguuacuguucuuuaggagcacuaugccugguuguucgggguaucccaauauggaucucgacugccuucugccacaggaguggguccagcacuucuaccaagaagcggccccugcacagucugauguggcuuugcuacgguuuguuaaccccgacacgggccgugugcuguucgaguguaaacuccauaaguccggauaugucacaguggcccacaccggccagcacgaucugguaauuccaccgaacggguacuuucgcuucgacucaugggugaaucaguucuauacucuugcaccuaugggaaacgguaccggcagaaggcgggcccuguga

SEQ ID NO: 18126 - RNA, 1623 nt, Artificial Sequence
  derived and/or modified sequence opt3 from VP1__Norovirus__ADR78911
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguugagcaccgauacaaguaaugacuucgagacuggucagaacaccagauuuacaccagucggcgugguucaagaugggucuaccacucaccagaaugaaccccagcagugggugcucccggacuacuccggaagggauagccacaacguacaucuggcuccugccgucgcaccaacguuccccggcgagcaauuacuguuuuuccggucgacaaugccugguuguucuggguaccccaauaugaaccucgacugccuucugccacaggaaugggugcagcacuuuuaucaggaguccgccccugcucaaucagauguugcguugcuacguuucgugaaucccgacaccggccgcguccuguuugaguguaaacuccauaagaguggauacgugacuguagcacacaccggccagcacgaucuggugaucccaccgaacggguauuucagauuugacagcuggguuaaccaguucuacacacuugccccuaugggaaauggugcuggcaggcggcgagcccuguga

SEQ ID NO: 18127 - RNA, 1623 nt, Artificial Sequence
  derived and/or modified sequence opt3 from VP1__Norovirus__ADR78914
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccagauucacaccagucggcgugguucaagaugggucuaccacucaccagaaugaaccccagcaguggguguugccggacuacuccggaagggauagccacaacguacaucucgcuccugccgucgcaccaacguuucccggcgagcaacuguuauucuuucggucgacaaugccugguuguucuggguaccccaauaugaaccuggacugccuccuuccacaggaaugggugcagcacuucuaucaggaguccgccccugcucaaucagauguugcgcuguugcguuuugugaaucccgacaccggccgcguccuauucgaguguaaacugcauaagaguggauacgugacuguagcacacaccggccagcacgaucucgugaucccaccgaacggguauuuuagauucgacagcuggguuaaccaguucuacacacuggccccuaugggaaauggugcuggcaggcggcgagcccuuuga

SEQ ID NO: 18128 - RNA, 1623 nt, Artificial Sequence
  derived and/or modified sequence opt3 from VP1__Norovirus__ADR78917
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggcggauccagggaguucuuacucaaacaacccgccgagacggcagcacgagaggccacaaggccaccgugucuacaggguccguccauuuuacuccuaagcugggaucagugcaguucagcaccgauacaaguaaugacuuugagacuggucagaacaccagguucacaccagucggcgugguucaagaugggucuaccacucaccagaaugaaccccagcaguggguguugccggacuacuccggacgggauagccacaacguacaucucgcuccugccgucgcaccaacguuucccggcgagcaacuguuauucuuucguucgacaaugccugguuguucuggguaccccaauaugaaccuggacugccuccuuccacaggaaugggugcagcacuucuaucaggaguccgccccugcucaaucagauguugcgcuguugcgcuuugugaaucccgacaccggcagaguccuauucgaguguaagcugcauaaaaguggauacgugacuguagcacacaccggccagcacgaucucgugaucccaccgaacggguauuuuagguucgacagcuggguuaaccaguucuacacacuggccccuaugggaaauggugcuggccggcgacgcgcccuuuga

SEQ ID NO: 18129 - RNA, 1623 nt, Artificial Sequence
  derived and/or modified sequence opt3 from VP1__Norovirus__ADR78920
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccagauucacaccagucggcgugguucaagauggggacaccacucaccagaaugaaccccagcaguggguguugccggauuacucuggaagggacucccacaacguacaucucgcuccugccgucgcaccaacguuucccggcgagcaacuguuauucuuucggagcacaaugccugguuguucgggguaccccaauaugaaccuggauugccuccuuccacaggaaugggugcagcacuucuaucaggagucugccccugcucaauccgacguugcgcuguugcguuuugugaaucccgauaccggccgcguccuauucgaguguaaacugcauaagucaggauacgugacuguagcacacaccggccagcacgaccucgugaucccaccgaacggguauuuuagauucgauaguuggguuaaccaguucuacacacuggccccuaugggaaauggugcuggcaggcggcgagcccuuuga

SEQ ID NO: 18130 - RNA, 1623 nt, Artificial Sequence
  derived and/or modified sequence opt3 from VP1__Norovirus__ADR78923
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacucaacuauuaaguugaucgcaaugcucuauaccccacugcgugcuaacaacgccggggaugacguguucacagucagcugcagaguucugaccaggcccaguccggauuuugacuucauuuuucucgugccucccacuguagaaucccggacaaaaccauucucugugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucgccggcacgcagaacuacacuaugaaucucgcaagccagaacuggaauaacuaugauccgacagaggaaauucccgcuccucuggguaccccagacuucguagggaagauccagggaguucuuacucaaacaacccggcgcgacggcucuacgcgaggccacaaggccaccguguccacagggucaguccauuuuacucccaagcugggaagcgugcaguucaguaccgauacaucuaaugacuuugagacuggucagaacaccagauucacaccugucggcgugguucaagauggguccaccacucaccagaaugaaccacagcaguggguguugcccgacuacagcggaagggauucgcacaacguacaucucgcuccggccgucgcaccuacguuuccaggcgagcaacuguuauucuuucggucuacaaugcccgguuguuccggguacccuaauaugaaccuggacugccuccuuccccaggaaugggugcagcacuucuaucaggagucagccccagcucaaagugauguugcgcuguugcguuuugugaauccugacaccggccgcguccuauucgaguguaaacugcauaagagcggauacgugacuguagcacacaccggccagcacgaucucgugauucccccaaacggguauuuuagauucgacuccuggguuaaccaguucuacacacuggccccgaugggaaauggugcuggcaggcggcgagcccuuuga

SEQ ID NO: 18131 - RNA, 1623 nt, Artificial Sequence
  derived and/or modified sequence opt3 from VP1__Norovirus__ADR78929
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucagcggcacgcggacuuaccgcaugaaccucgccucucagaauuggaacaauuaugauccgacagaggaaauucccgcaccucuggguaccccagacuucguagggaagauccagggaaugcuuacucagacaaccaagggcgacggcuccacgcgagggcacaaggcuaccguuucaacaggaagcguggauuuuacucccaaacuggguaguguccaauucgccaccgacacagauaacgacuuugagacuggccagaauaccagauucacaccugugggggucauccaggauggaucuuccgcucauaggaacgaaccacaacaguggguguugcccgacuacagcggccggaccguucacaaugugcaccucgccccggcaguagccccuacuuuuccaggugagcagcuguuauucuuucguucgacgaugcccggguguucuggcuacccuaacauggaucuggacugccuccuuccccaggaauggguccaacauuucuaucaggaggcugcgccaucccagucagauguggcacuguugcgcuuuguuaauccugacacaggaagagugcuauucgaguguaagcugcacaaagccggcuacgucaccguggcucauacugggcagcacgaucucguaauucccccaaacggauauuuuagguucgacaguugggugaaucaauucuacacccuggccccgauggguaacggcgcagggcggcgacgcgcccuuuga

SEQ ID NO: 18132 - RNA, 1623 nt, Artificial Sequence
  derived and/or modified sequence opt3 from VP1__Norovirus__ADR78932
augaagauggccagcuccgacgcuucucccucagauggcagugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagagcaacgacaguaccauuaaguugaucgcuaugcucuauacaccacugcgugccaauaacgcgggggaugacguguucacugucuccugcagaguucugaccaggcccucuccggauuuugacuucauuuuucucgugccucccacaguagaaagccggaccaaaccauucacugugccuaucuuaacagucgaggaaaugaccaacucccgcuuucccauaccacuggagaaacuuuucacgggacccucaagugccuucgugguucagccucagaaugguagauguacuaccgauggcguguugcuggggacaacucaacuaagcccagucaacauuugcaccuuuaggggagacgugacacauaucucuggcucccggaauuaccgcaugaaccucgcaucacagaauuggaacaauuaugauccgaccgaggaaauucccgcuccucuggguacgccagacuucguagggaagauccagggaaugcuuacucagacaaccaagggcgacggcagcacucgagggcacaaggccacaguuaguaccggaucuguggauuuuacgcccaaacuggguuccguccaauucgcuaccgacacagauaacgacuuugagacuggccagaauaccagauucacaccugugggggucauccaggauggaagcucggcccauaggaacgaaccacaacaguggguguugcccgacuacucuggccggacuguucacaaugugcaccucgcaccggccguagcuccuaccuuuccaggugagcagcuguuauucuuucguuccacaaugcccggguguucaggcuacccuaacauggaucuggacugccuccuuccccaggaauggguccaacauuucuaucaggaggcggcaccaagucagagcgauguggcccuguugcgcuuuguuaauccugacaccggaagagugcuauucgaguguaagcugcacaaagcuggcuacgucacuguggcccauacggggcagcacgaucucguaauucccccaaacggauauuuuagguucgacuccugggugaaucaauucuacacacuggcaccgauggguaacggcgccgggcggcgacgcgcucuuuga

SEQ ID NO: 18133 - RNA, 1623 nt, Artificial Sequence
  derived and/or modified sequence opt3 from VP1__Norovirus__ADR78938
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggagcuaccgcaugaaccucgccucucagaauuggaacaauuaugaucccacugaggaaauuccugcaccacuggguacacccgacuucguagggaagauccagggaaugcuuacccagacuacaaagcgagacggcuccaccagaggccacaaggcuacgguuucaaccgggagcguggauuuuacaccuaaacugggaaguguccaauucgccacugacaccgauaacgacuuugagacaggucagaauacuagguucaccccagugggcgucauccaggaugggucuuccacacaucggaacgaaccccaacaguggguguugccggacuacagcggacguaccguucacaaugugcaccucgcuccugccguagcaccaacuuuucccggcgagcagcuguuauucuuucgcucgacgaugccugguuguucuggguaccccaacauggaucuggacugccuccuuccacaggaauggguccaacauuucuaucaggaggccgcuccuucccagucagauguggcgcuguugagauuuguuaaucccgacacaggcagggugcuauucgaguguaagcugcacaaagcaggauacgucaccguggcccauacuggccagcacgaucucguaauuccaccgaacggguauuuucgguucgacaguugggugaaucaauucuacacccuggcuccuaugggaaacggugccggccgacgcagagcacuuuga

SEQ ID NO: 18134 - RNA, 1623 nt, Artificial Sequence; identical to SEQ ID NO: 17975
  derived and/or modified sequence opt3 from VP1__Norovirus__ADR78941

SEQ ID NO: 18135 - RNA, 1623 nt, Artificial Sequence
  derived and/or modified sequence opt3 from VP1__Norovirus__ADR78944
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucagcggcucucggacguaccgcaugaaccucgccucccagaauuggaacaauuaugauccgacugaggaaauucccgcaccucuggguacaccagacuucguagggaagauccagggaaugcuuacccagacuacaaagggcgacggcucaacccgagggcacaaggcuacgguuagcaccggaaguguggauuuuacacccaaacuggguucuguccaauucgccacugacaccgauaacgacuuugagacaggccagaauacuagauucaccccugugggggucauccaggauggauccagcacacauaggaacgaaccacaacaguggguguugcccgacuacucgggccggaccguucacaaugugcaccucgcuccggccguagcaccuacuuuuccaggugagcagcuguuauucuuucguucuacgaugcccggguguuccggcuacccuaacauggaucuggacugccuccuuccccaggaauggguccaacauuucuaucaggaggccgcuccaucacagagugauguggcgcuguugcgcuuuguuaauccugacacaggaagagugcuauucgaguguaagcugcacaaagcaggcuacgucaccguggcccauacugggcagcacgaucucguaauucccccaaacggauauuuuagguucgacagcugggugaaucaauucuacacccuggcuccgauggguaacggcgccgggcggcgacgcgcacuuuga

SEQ ID NO: 18136 - RNA, 1623 nt, Artificial Sequence; identical to SEQ ID NO: 17975
  derived and/or modified sequence opt3 from VP1__Norovirus__ADR78947

SEQ ID NO: 18137 - RNA, 1623 nt, Artificial Sequence
  derived and/or modified sequence opt3 from VP1__Norovirus__ADR78950
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcagguccuacucgcaggaaacgccuuuacagcuggcaaaauuaucuucgccgcagugccuccaacuuuuccgacggagggccugucucccucgcagguaaccauguucccucauauuaucguugacgugcgccaacuugagccaguccugauacccuugccugaugugcgaaauaacuuuuaucacuacaaucagucaaacgacagcacaaucaagcucguggcuaugcuguauacuccacugcgugccaauaacgcgggggaugacgucuucaccguuaguugcagagugcucacaaggcccuccccggauuuugacuucaucuuuuuaguaccucccaccguggaaucucggacuaaaccauucacagucccuauucugaccguggaggaaaugacgaacagccgcuuucccauuccacuugagagauuguucacuggacccuccucagccuucguugugcagccucagaaugguagguguaccacagauggcguccugcuagggacuacccaacucaguccagugaacaucugcacauuucggggagacguaaccaauauaccgggcagccgcacguaccgaaugaaccuggcaucucagaauuggaacaauuaugaucccacugaggaaauuccugcuccacuugguacacccgacuucguugggaagauccagggagugcugacccagacuacaaaaggcgacggcuccaccagagggcauaaggccacggucaggaccggaucagcugauuuuacaccuaaguuggguagcgugcaauucgccacugacaccgauaacgacuuugucacaggccagaauacucgguucaccccaguggggguuauucacgauggaaguucugcacaucguaacgagccccagcaaugggugcucccggaauacuccggccgcagcguacacaauguccaccuggccccugcuguggcgccaacauuucccggugagcaguuacuguucuuuagaucgaccaugccuggguguucuggcuaccccaacauggaccucgauugccuucugccacaggaauggguucagcauuucuaucaagaggcagccccuucccagucagacguggcuuugcuaagguuugucaaucccgauacuggacgggugcuguucgaguguaaacuccacaaggccggcuacguaacgguggcacauacagggcagcacgaccugguuaucccaccgaacggauauuuucgauucgauaguugggucaaucaguucuacacccuugccccuauggguaacggcgcugggcgcagaagggcccuguga

SEQ ID NO: 18138 - RNA, 1623 nt, Artificial Sequence
  derived and/or modified sequence opt3 from VP1__Norovirus__ADR78956
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcgagggcacaaggcuaccguuuccacaggaucaguggauuuuacuccuaaacuggguagcguccaauucgccaccgacacagauaacgacuuugagacuggccagaauaccagauucacaccagugggggucauccaggauggaaguucugcucauaggaacgaaccccaacaguggguguugccggacuacuccggccggaccguucacaaugugcaccucgccccugcaguagccccaacuuuucccggugagcagcuguuauucuuucguagcacgaugccuggguguucgggcuaccccaacauggaucuggacugccuccuuccacaggaauggguccaacauuucuaucaggaggcugcgccugcacagucugauguggcccuguugcgcuuuguuaaucccgacacaggaagagugcuauucgaguguaagcugcacaaaaccggcuacgucacuguggcucauaccgggcagcacgaucucguaauuccaccgaacggauauuuuagguucgacuccugggugaaucaauucuacacacuggccccuauggguaacggcgcagggcggcgacgcgcccuuuga

SEQ ID NO: 18139 - RNA, 1653 nt, Artificial Sequence
  derived and/or modified sequence opt3 from VP1__Norovirus__AEA02124
augaugauggccagcaaggacgcuaccuccaacauggauggcacaucuggggcaggacagcuggugcccgagaauaacaauacuucagaaccuaucaacauggagccagucgccggugcgguuacggcugccgcaaccgccggccaagugaauaugauugacccguggauaaugaacaauuacguacaggcuccccagggggaguucacaaucaguccuaacaauacuccaggagauauucucuuugaccuucagcugggcccccacuugaacccuuucuuagcacaucugagccaaauguauaaugguuggguggggaacaugaaagucagagugguucuagccggaaaugcuuuuuccgccggcaagaucauugugugcuguaucccacccggcuucucugcgccuaacauaucgaucgcacaggccaccauguuuccacacgucauugcugaugugaggguacucgaaccgaucgacauuccccuggaugacguucggaaugugcuuuuccauacaaacgauaacgggaaucagaccaugcgccuguugugcaugcucuacacuccucugcgaucaggagguacaagcaguggcaccgacccauuugucaucgccgggcgugugcugacgugucccacuccugauuucaacuuucucuucuuagugccacccaccgucgaacagaaaacaaagcaauuuuccguuccgaaucugccucuuaacgugaugucuaauagcagaguacccuccuugcugaacgcaaugguggucucaccagaccaggcucaggugguucaguuccaaaauggaaggugcacucuagauggccagaugcucgguaccacaaccgugagugccagcugugucgcgcgguuucgcgggaaaacguuccaggccccugacaacagacugggaauaaaucuugcagagauuucuggcgagcccuaucacgcuuucgaauccccagcuccccugggcuuuccugacuucggggauggagacuggcaugugacugccacaaagguaaccccaucacaauuggaggccaacgauccgguuguggucgguaaugugcagcccuacaacccucaguuugcaccacaccucggcacucuggucguggaaaaucccacaccugaccagguugccaccgggacggauuuacuguucaacaucaccuggcucagcaauagggcuaacaaccgguuuaauccaugggugauucccaacuauggaaguacacuuacugaggcggcacaacuggccccgucuaucuucccuccaggcuuuggugagaccaucguauacuucaauuccacauuucccgcugucggggccacuacccacgcagccauuccuugcuugcuaccccaggaguucguggcucauuuuguuaacgaacaggccccaauacgcggcgaagcagcgcugcuccacuauaucgacccugauacacaucgaaaucugggagaguucaagauuuaccccgaaggcuuugugaccugugucccaaacguagggggaacugguccgcagagccuuccuacgaauggcguguucguguucguuucgugggucucuagauacuaucaacugaaacccguggggacagcuggacaggccaggcgguugggcuuucgucgcguguga

SEQ ID NO: 18140 - RNA, 1647 nt, Artificial Sequence
  derived and/or modified sequence opt3 from VP1__Norovirus__AED02033
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuaucccuccuaacuuuccaauagauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguacacaccccucagagcaaauaacucuggagaugacguuuucaccgugucguguagggucuuaacucggccuucaccagauuuuagcuucaauuuucuggugcccccgaccguggagaguaagacaaaaccuuucacccuucccaucuugacuauauccgaaaugucuaacagccgcuuuccagucccuauugacucccugcauacaucacccaccgagaauaucguugugcagugccagaacgguagaguaacgcuagauggcgagcucauggggacuacccaacugcuuccaagucagauuugugcuuucaggggaacacugauccggagcacuucucgcgccuccgaccaggcugauaccucaacaccccgauuguucaauuauuacuggcacauccagcucgacaaccugaauggcaccccuuaugacccagccgaagauauuccggcacccuuagguacgccugacuuuagagggaagguguucggagucgccagccaaaggaacccagauaguacuacacgggcucaugaggcgaaaguggacaccacuucuggccguuuuacacccaagcugggcucccucgaaauaaucaccgagagcgaugacuucgaucuuaaucagucgacgaaguuuaccccuguugggauuggaguggacaacgaagcagaguuccagcaauggucucugccaaauuacuccggucaguuuacacacaacaugaauuuggcccccgcugucgccccgaacuucccuggcgagcagcuacuguuuuuccgcucacagcucccaaguagcgggggaagauccaacggcgugcuggauugccuuguaccccaagaauggguucagcacuuuuaccaggagucugcacccgcccagacucaaguggcucuggucagguaugugaaucccgacaccggucgggucuuguucgaagccaaacuccauaagcugggguuuaugacaaucgcgaaaaacggcgauagcccaauaacugugccucccaauggauacuuccgauucgagucauggguuaacccauuuuauaccuuagcaccgaugggcacagggaauggacgcagaaggauucaguga

SEQ ID NO: 18141 - RNA, 1647 nt, Artificial Sequence
  derived and/or modified sequence opt3 from VP1__Norovirus__AED02034
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguacacaccccucagagcaaauaacucuggagaugacguuuucaccgugucguguagggucuuaacucggccuucaccagauuuuagcuucaauuuucuggugcccccgaccguggagaguaagacaaaaccuuucacccuucccaucuugacuauauccgaaaugucuaacagccgcuuuccagucccuauugacucccugcauacaucacuaaccgagaauaucguugugcagugccagaacgguagaguaacgcucgauggcgagcugauggggacuacccaacuucugcccagucagauuugugcuuucaggggaacauugacucggagcaccucucgcgccuccgaccaggcugauacagccaccccacgacucuucaauuauuacuggcacauccagcugaacaauuuaaacggcacgcccuaugacccugcagaagacaucccagccccgcuggguacucccgauuuuagagggaagguguucggagucgcuucacaaaggaauccugacagcacaacccgggcgcaugaggcaaaaguggauacuacaaguggccguuuugccccaaagcucggcucucuugaaauuuccaccgagacggacgauuucaaccagaaucagcccacccgcuuuacaccuguugggauaggaguggacaacgaagcugauuuccaacaguggagccugccagacuacucgggucaguuuacucacaauaugaacuuggcccccgcagucgccccgaacuucccuggcgagcagcuacuguuuuucagaucucaacucccauccucagggggaaggaguagcggcauccuggauugccuugugccccaggaguggguacagcacuuuuaccaggaauccgcuccugcccaaacccagguugcacuggugcgguaugucaaucccgacacaggucgaguguuguucgaggcgaagcuccauaaacugggguuuaugacuauugcuaagaacggcgauucuccaaucaccgucccucccaauggauacuuccgcuucgaaagcugggugaacccauuuuauacauuagccccgaugggcaccgggaauggaagaaggcggauacaguga

SEQ ID NO: 18142 - RNA, 1647 nt, Artificial Sequence
  derived and/or modified sequence opt3 from VP1__Norovirus__AED02035
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguacacaccccucagagcaaauaacucuggagaugacguuuucaccgugucguguagggucuuaacucggccuucaccagauuuuagcuucaauuuucuggugcccccgaccguggagaguaagacaaaaccuuucacccuucccaucuugacuauauccgaaaugucuaacagccgcuuuccagucccuauugacucccugcauacaucacccaccgagaauaucguugugcagugccagaacgguagaguaacgcuagauggcgagcucauggggacuacccaacugcuuccaagucagauuugugcuuucaggggaacacugacucggagcaccucucgcacaggcgaccaggccgauaccgcuucaccccgauuguucaauuauuacuggcacauccagcucgacaaccugaaugguacgccuuaugacccagccgaagauaucccggcacccuuagggacuccugacuuuagaggaaagguguucggcgucgccucccaaaggaacccagauagcacaacccgggcucaugaggcgaaaguggacacuacaaguggccguuuugcacccaagcuggggucucucgaaauuuccaccgagagcgaugacuucgauucgaaucagccuacgcgcuuuaccccaguuggaauagguguggacagagaaacagauuuccagcaauggacucuucccgaguacucuggccaguuuacccacaacaugaaucuggccccggcugucgccccuaacuucccaggggagcaguugcuauuuuucaggucccagcugcccucaaguggaggccggagcggugggauccucgacugccuggugccucaagaauggguacagcacuuuuaccaggaguccgcacccgcccagacacaaguugcucuugugcgauaugucaauccagauacuggccgcgugcuguucgaagccaaguugcauaaacucggauuuaugaccauugcaaagaacggcgacucuccuaucacagugcccccaaacggguacuucagauucgagagcugggucaauccguuuuauacccuggcgccuaugggaacugguaacggcaggcggcgcauacaguga

SEQ ID NO: 18143 - RNA, 1647 nt, Artificial Sequence
  derived and/or modified sequence opt3 from VP1__Norovirus__AED02037
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgacaaucuuagugccgcgcagaucacgaugugcccgcaugugauugucgaugugcggcaacuggagcccaucaacuugccuaugccagacguacgcaauaacuucuuucacuauaaccaggggagcgauucccgacuccgucugauugccaugcuguacacaccccucagagcaaauaacucuggagacgauguuuucaccgugucguguagggucuuaacucggccuucaccagacuuuagcuucaauuuucuggugcccccgaccguggaaaguaagacaaaaccuuucacccuucccaucuugacuauauccgagaugucuaacagccgcuuuccagucccuauugauucccugcauacaucacccaccgaaaguaucguugugcagugccagaaugguagaguaacgcuagacggcgagcucauggggacuacccaacugcuuccaaaccagauuugugcuuucaggggaacacugacucggagcaccaaucgcgccucugaucaggcugacacagccacgccccgauuguucaaccaccauuggcacauccagcucgacaaucugaacggcaccccuuaugauccagcagaggacaucccggcccccuuagguacuccugauuuuagagggaagguguucggagucgcuucccaaaggaauccagacucaacaacccgggcgcacgaagcaaaaguggauacuacaagcggccguuuuacccccaagcugggcagucucgagauuacgaccgaaucugacgauuucgacccuaaccaguccacaaaguuuacuccaguugggauaggaguggauaaugaggccgacuuccagcaauggagccuucccgauuacucgggucaguuuacccauaacaugaaucuggcuccggccgucgcaccuaacuucccaggcgaacaguugcuauuuuuccgcucucagcugcccuccucagggggaagaaguaacggcauccucgacugccuggugccucaagaguggguacagcacuuuuaucaggagagcgcccccgcucagacacaaguugcccuugugagguacgucaauccagacacuggucgggugcuguucgaagcaaaauugcauaagcucggguuuaugaccauugcgaaaaacggcgauuccccuaucacagugcccccaaauggauacuuccgauucgagucuugggucaacccguuuuauacccuggcuccuaugggcacugggaauggacgcagaaggauacaguga

SEQ ID NO: 18144 - RNA, 1647 nt, Artificial Sequence
  derived and/or modified sequence opt3 from VP1__Norovirus__AED02038
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguacacaccccucagagcaaauaacucuggagaugacguuuucaccgugucguguagggucuuaacucggccuucaccagauuuuagcuucaauuuucuggugcccccgaccguggagaguaagacaaaaccuuucacccuucccaucuugacuauauccgaaaugucuaacagccgcuuuccagucccuauugacucccugcauacaucacccaccgagaauaucguugugcagugccagaacgguagaguaacgcuagauggcgagcucauggggacuacccaacugcuuccaagucagauuugugcuuucaggggaacacugacucggagcaccucucgcgccggcgaccaggcugauacagccacgccccgauuguucaauuauuacuggcacauccagcucgacaaccugaaugguaccccuuaugacccagcagaagauaucccggcccccuuagggacuccugacuuuagaggaaagguguucggcgucgcuucccaaaggaacccagauucaacaacccgggcgcaugaggcaaaaguggacacuacaagcggccguuuugcccccaagcuggggagucucgaaauuucuaccgaguccagcgauuucgacucgaaucagccuacgcgcuuuaccccaguuggaauagguguggauaacgaagcugacuuccagcaauggucucuucccgauuacuccggccaguuuacacacaauaugaaccuggccccggcagucgccccuaauuucccaggggagcaguugcuauuuuucagaucacagcugcccaguagcggaggcagguccaacgguauccucgacugccuggugccucaagaguggguacagcacuuuuaccaggaaucugcucccgcccagacucaaguugcacuugugcgguaugucaacccagauaccgggcgagugcuguucgaggcgaaguugcauaaacucggcuuuaugacaauugcuaagaauggagacagcccuaucacugugcccccaaacggcuacuuccgcuucgaaucaugggucaauccguuuuauacccuggccccuauggggacaggaaacgguagaaggcggauacaguga

SEQ ID NO: 18145 - RNA, 1647 nt, Artificial Sequence
  derived and/or modified sequence opt3 from VP1__Norovirus__AED02039
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguacacaccccucagagcaaauaacucuggagaugacguuuucaccgugucguguagggucuuaacucggccuucaccagauuuuagcuucaauuuucuggugcccccgaccguggagaguaagacaaaaccuuucacccuucccaucuugacuauauccgaaaugucuaacagccgcuuuccagucccuauugacucccugcauacaucacccaccgagaauaucguugugcagugccagaacgguagaguaacgcuagauggcgagcucauggggacuacccaacugcuuccaagucagauuugugcuuucaggggaacacugacucggagcaccucucgcgccggcgaccaggcugauacagccacgccccgauuguucaauuauuacuggcacauccagcucgacaaccugaaugguaccccuuaugacccagcagaagauaucccggcccccuuagggacuccugacuuuagaggaaagguguucggcgucgcuucccaaaggaacccagauucaacaacccgggcgcaugaggcaaaaguggacacuacaagcggccguuuugcccccaagcuggggagucucgaaauuucuaccgaguccagcgauuucgacucgaaucagccuacgcgcuuuaccccaguuggaauagguguggauaacgaagcugacuuccagcaauggucucuucccgauuacuccggccaguuuacacacaauaugaaccuggccccggcagucgccccuaauuucccaggggagcaguugcuauuuuucagaucacagcugcccaguagcggaggcaggucccacgguauccucgacugccuggugccucaagaguggguacagcauuuuuaccaggaaucugcucccgcccagacucaaguugcacuugugcgguaugucaacccagauaccgggcgagugcuguucgaggcgaaguugcacaaacucggcuuuaugacaauugcuaagaacggagacagcccuaucacugugcccccaaauggcuacuuccgcuucgaaucaugggucaacccguuuuauacccuggccccuauggggacaggaaauaaaagaaggcggauacaguga

SEQ ID NO: 18146 - RNA, 1623 nt, Artificial Sequence
  derived and/or modified sequence opt3 from VP1__Norovirus__AEG79290
augaagauggccagcaacgacgcuaaucccuccgauggcucugcagccaaccuggugccugaggucaauaacgaaguuauggcgcucgagccaguggcuggggccgcacuugccgcuccgguagcaggacagcaaaaugugaucgaccccuggauuagaaacaauuucguccaggccccugguggcgaauuuaccgugucaccaaggaacgcucccggggagauacuguggagugccccuuugagcccagauuuaaaucccuaccugucccaccuagcgcggauguauaacucuuacgcaggaggcuucgaaguucaggugauccucgccgguaaugcuuuuacagccgggaaaauuaucuucgcagcugucccuccaaacuuuccgauugagggacugucgcccucacaggugacuauguucccucauaucauaguagacguucgccaacuugagccagugcugauccccuugccugauguccgaaauaacuuuuaucacuacaaucagagcaacgaaccaacgauuaagcucaucgccaugcuguauacccccuuacgugcgaacaaugccggcgaggacguguucacagugaguugcagaguccucacuaggccguccccugauuuugacuucauuuuucugguucccccaaccguggaaucucggacaaaaccuuucaccguacccauccugacuguggaggagaugacaaacagccgcuuuccaauaccccuugaaaaguuguucaccggcccuuccucaaguuucgucgugcagccacagaaugggagauguacgacugauggaguucugcuagguaccacacaacucagcccggugaacauuugcacuuuuaggggcgacgucacccauaucgcagggucucggaauuacacaaugaaccuggcuuccauuaauuggaacaauuaugaucccaccgaggaaaucccugccccacuuggaacgcccgacuucgugggcaaaauccaggguaugcugacucagacaacccgcggggauggaucaacucgaggccacagagcuacaguauacaccggcagcgccccuuuuacgccaaaguuggggaguguucaguucaccacagacacugacaacgauuuugagaccaaucaaaacacaaaguucacucccgugggagucgugcaggacggugauaccgcacauaggaaugaaccgcagcaauggguccucccuucuuacuccggccggaacgugcagaauguucaccuggccccagcuguggcgcccacauuuccuggggagcaguuacuguucuuucguagcaccaugcccggauguucgggcuauccaaacauggaccucgauugccuucugccucaggaguggguacaacacuucuaccaggaagcagcccccgcucagucugacgucgccuugcuacgcuuugugaacccagauacugguagaguucuguucgaguguaaacuccauaaguccggguaugugacggucgcacacacaggccagcaugaccuggugauuccgccuaauggauacuuuagguucgauucauggguaaaccaauucuauacccuugcccccaugggcaaugggacuggacggcgacgcgcucuguga

SEQ ID NO: 18147 - RNA, 1608 nt, Artificial Sequence
  derived and/or modified sequence opt3 from VP1__Norovirus__AEI29586
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggaggucuuguuaaaucuggaacuaggaccugagcucaacccauaccuggcccaccuuagccggauguauaauggcuacgcuggugggguggagguucaggugcuguuggccggaaacgcguucacggcaggcaaacucgucuuugccgcugugcccccucauuucccacuggaaaauaucuccccgggccagauuaccauguuuccccacguaaucauugauguucgcacacuggagccugugcucuuaccacugcccgacguccgaaacaauuucuuucauuauaaccagcaaaacgaaccucguaugagacuuguggccauguuguacacuccacugaggucuaaugggucgggagaugacguguucaccgucucaugccggguucuaacacgccccagcccggauuuugacuucaacuaucucgugccucccaccguagagaguaagacuaaaccauuuacacugccuauccuuaccauaggugagcugacuaauuccagauuccccgugccaaucgaugaauuguacacgucucccaacgagagccucgucgugcagccucagaaugggaggugugcacuggacggcgaauuacagggaaccacacaacugcucccaacugcuauuugcuccuuucggggccgcaucaaccagaagguuucaggugagaaucacguguggaacaugcaggucaccaauauugaugggacaccguucgaccccaccgaagaugugccugccccacuuggaacgcccgacuucaguggcaaacuguuuggcguauugagccagcgagaccaugauaacgcguguagaucucacgacgccguuaucgcaacuaauuccgcuaaguucacaccuaagcuaggggccauacaaauuggaaccugggagcaggaugacgugcacaucaaccagccaacuaaauuuacacccgucggucuguucgagucagaaggcuuuaaucaauggacccucccgaacuauagcggggcucugacgcuuaauaugggacuggccccuccaguggcacccaccuucccuggcgagcagauuuuguuuuucaggagucauaucccccucaaggguggggucgccgauccagugaucgacugccuguuaccucaggaauggauucagcaccuguaccaagagucugcucccucccagacagauguugcgcuaauacgguuuacuaacccagacaccggccguguacucuucgaagcaaaacugcaucgcagcggauacaucacaguggccaacacuggcucgagaccgauugucgugccugcuaauggguauuuuagguucgauucuuggguuaaccaguuuuacucccuugcccccaugggaaccgguaauggccggcgacgcgugcaguga

SEQ ID NO: 18148 - RNA, 1623 nt, Artificial Sequence
  derived and/or modified sequence opt3 from VP1__Norovirus__AEJ82646
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacguguuuacggcaggcaaaaucauuuucgccgcuguaccuccaaauuuuccgaccgagggccucucccccucucagguuacaauguucccucauaucauaguggacguccgccaacuggagccagugcuuaucccccugccugaugugcgaaacaauuuuuaucacuacaaccagucgaaugacccaacuauuaaguugaucgccaugcucuauacgccccugcgugcaaacaacgcuggggaugacgucuucacaguuucaugcagagugcugaccaggccgagcccugauuuugacuucauuuuucucgcgcccccaacuguagaaagucggacaaaaccuuucuccgugcccaucuuaaccgucgaggaaaugaccaauucucgcuuuccaauaccccuggagaaacuuuucacuggaccuagcuccgccuucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucaauccaguucagcaccgauacaaguaaugacuuugagacuggucagaacaccagauucacaccagugggcgucgugcaagaugggucuaccacucaccagaaugaaccccagcaguggguuuugccggacuacuccggaagggauagccacaacgugcaucucgcuccugccguagcaccaacguuucccggcgagcaacuguuauucuuucggucgacaaugccugguuguucuggguaccccaauaugaaccuggacugccuccuuccacaggaauggguccagcacuucuaucaggaguccgccccugcucaaucagauguggcgcuguugcguuuuguuaaucccgacaccggccgcgugcuauucgaguguaaacugcauaagaguggauacgucacuguggcacacaccggccagcacgaucucguaauuccaccgaacggguauuuuagauucgacagcugggugaaccaguucuacacacuggccccuaugggaaauggugcuggcaggcggcgagcccuuuga

SEQ ID NO: 18149 - RNA, 1623 nt, Artificial Sequence
  derived and/or modified sequence opt3 from VP1__Norovirus__AER11308
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccagauucacaccagucggcgugguucaagaugggucuaccacucaccagaaugaaccccagcaguggguguugccgaacuacuccggaagggacagccacaauguacaucucgcuccugccgucgcaccaacguuucccggcgagcaacuguuauucuuucggucgacaaugccugguuguucuggguaccccaacaugaaucuggauugccuccuuccacaggaaugggugcagcacuucuaucaggaguccgccccugcucaaucagacguugcgcuguugcguuuugugaaccccgauaccggccgcguccuauucgaguguaaacugcauaagaguggauacgugacuguagcacacaccggccagcacgaccucgugaucccaccgaacggguauuuuagauucgauagcuggguuaaucaguucuacacacuggccccuaugggaaacggugcuggcaggcggcgagcccuuuga

SEQ ID NO: 18150 - RNA, 1623 nt, Artificial Sequence
  derived and/or modified sequence opt3 from VP1__Norovirus__AER11310
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuguaaaucucgcaagucagaacuggaauaacuaugaucccacagaggaaauuccugcuccacuggguacccccgacuucguugggaagauccagggagugcuuacucaaacaacccggcgcgacggcagcacgcgaggccacaaggccaccgucucuacaggguccgugcauuuuacuccuaagcugggaucaguccaguucagcaccgauacaaguaaugacuuugagacuggucagaacaccagauucacaccagugggcguugugcaagaugggucuaccacucaccagaaugaaccccagcaguggguauugccgaacuacuccggaagggacagccacaauguccaucucgcuccugccguggcaccaacguuucccggcgagcaacuguuauucuuucggucgacaaugccugguuguucuggguaccccaacaugaaucuggauugccuccuuccacaggaauggguucagcacuucuaucaggaguccgccccugcucaaucagacguggcgcuguugcguuuugucaaccccgauaccggccgcgugcuauucgaguguaaacugcauaagaguggauacguaacuguggcacacaccggccagcacgaccucguuaucccaccgaacggguauuuuagauucgauagcugggucaaucaguucuacacacuggccccuaugggaaacggugcuggcaggcggcgagcccuuuga

SEQ ID NO: 18151 - RNA, 1623 nt, Artificial Sequence
  derived and/or modified sequence opt3 from VP1__Norovirus__AER11312
augaagaucgccagcuccgacgcuaaccccucugauggcucaaccgcaaaucuggugccugaggucaacaaugaaguuauggcccucgagccagugguaggggcggcuauugccgcaccgguggccggacagcaaaacgucauagaccccuggaucagaaauaacuucgugcaggcuccugguggcgaauuuacaguuaguccaaggaaugcacccggggagauucuuuggagcgccccucugggaccagauuugaaccccuacuuaucccaccuggcucggauguauaauucuuacgccggcgguuucgaagugcaggucauccuagcggggaacgcauuuacugccggaaaaauuaucuucgcugccgugccuccaaauuuuccgacggagggccucucgcccucacagguaaccauguucccucauauaaucguugacgugcgccaacuggagccaguccuuauuccccugccugaugugcgaaacaauuuuuaucacuacaaccagagcaaugacccaacaaucaaguugauugcaaugcucuauacuccccugcgugcuaacaacgccggcgaugacguguucaccgucaguugcagaguucugacaaggccguccccugauuuugacuucaucuuucucgugcccccaaccguagaaucucggacuaaaccuuucagcgugcccauauuaacagucgaggaaaugaccaauucccgcuuuccaauuccccuggagaaacuuuucacggggccuucaagugcguucgugguucagccacagaacggaagauguacuaccgaugguguguugcugggcacaacucaacuaagcccggucaauaucugcaccuuuagaggggacgugacacauauugccucuacccaggaguacacgaugaaccucgcaucccagaauuggaacaauuaugaucccacugaagagaucccugcuccacugggaacacccgacuucguaggcaagauccaggguguucuuacccaaacuacacggcgcgacgggucaacccgaggacacaaggccacggugagcaccggcaguguccauuuuacaccuaagcugggcaggauucaguucucuacugauaccuccaacgacuuugaaacagggcagaauacuagguucaccccagugggagucgugcaagaugguagcacaacccaccagaacgagccccagcaguggguuuugccgaauuacucgggccgggacucucacaacgugcaucucgcuccugccguagcaccauccuuucccggggaacaacuguuauucuuucguucaacuaugccuggauguaguggcuaccccaauaugaaccuggauugccuccuuccacaggaguggguccagcacuucuaucaggaggccgcuccugcgcaaagcgacguggcacuguugcgcuuuguuaaucccgauacggguagagugcuauucgaauguaaacugcauaaguccggguacgucacaguggcccacaccggccagcacgaccucguaauaccaccgaacggauauuuuagguucgauucuugggugaaccaguucuacacucuggcuccuaugggcaaugggaccggacggcgacgcgcccuuuga

SEQ ID NO: 18152 - RNA, 1623 nt, Artificial Sequence
  derived and/or modified sequence opt3 from VP1__Norovirus__AER11314
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguacccggaauuacacgaugaaccucgcuucacugaauuggaacaauuaugacccgacugaagagauucccgccccucuugggacaccagauuucguaggaaagauccagggcguucugacccagacuacaaagggcgacgggaguacccgcggacacaaggcuacgguguacaccgguagcgcccccuuuacaccuaaauugggcucuguccaguucuccacugacaccgaaaacgauuuugagacacaucaaaauacuaaguucaccccagugggggucauccaggacggaggcacaacccaccgaaacgaaccccagcaaugggugcucccgucauacagcgguagaaauguucacaacgugcaucuggccccugcaguagcuccaacuuuucccggggagcaguuacuguucuuuaggaguacgaugccuggcuguucuggauaucccaauauggaucucgacugccuucugccacaggaguggguccagcacuucuaccaagaagcggccccugcacaguccgauguggcuuugaugcgguuuguuaaccccgacacaggccgugugcuauucgaguguaaacugcauaagagcggguaugucaccguggcccacacuggacagcacgaucucguaauuccaccgaacgguuacuuucgcuucgacucgugggugaaucaguucuauacccuggcaccuaugggcaacgggacaggaagaaggcgggcccuuuga

SEQ ID NO: 18153 - RNA, 1623 nt, Artificial Sequence; identical to SEQ ID NO: 18112
  derived and/or modified sequence opt3 from VP1__Norovirus__AER11316

SEQ ID NO: 18154 - RNA, 1623 nt, Artificial Sequence; identical to SEQ ID NO: 18112
  derived and/or modified sequence opt3 from VP1__Norovirus__AER11318

SEQ ID NO: 18155 - RNA, 1623 nt, Artificial Sequence
  derived and/or modified sequence opt3 from VP1__Norovirus__AER11320
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucguuguggacguccgccaacuggagccagugcuuauaccccugccugaugugcgaaauaacuuuuaucacuacaaucagucgaacgacucaaccaucaaguugauugcuaugcucuauacaccacugcgugccaacaaugcgggggaagaugucuucacuguuagcugcagagugcugaccaggcccaguccggacuuugauuucaucuuucucguaccucccacaguggagucccggaccaaaccauucacugucccuauuuuaacaguggaagagaugaccaacucucgcuuucccaucccacuggagaaacuuuucacgggacccagcggugccuucguugugcagccucagaauggcagauguacuaccgacggggucuugcugggaacaacucaacuauccccagugaacauaugcaccuuuaggggcgauguaacacauauugcagguucacggaauuacaccaugaaccucgcuagucugaauuggaacaauuaugacccgacggaagagauccccgccccucuugggacuccagauuucguuggaaagauucagggcgugcugacacagaccacuaagggcgacgggagcacacgcggacacaaggcuaccgucuacacggguucugcccccuuuaccccuaaauugggcuccgugcaguucucaacagacacugaaaacgauuuugagacccaucaaaauacaaaguucacuccagucggggugauccaggacggaagcaccacacaccgaaacgaaccccagcaauggguucucccgaguuacucuggcagaaaugugcacaacguacaucuggccccugcagucgcuccaaccuuucccggugagcaguuacuguucuuuagguccacuaugccuggguguagcggcuaucccaauauggaucucgacugccuucugccacaggagugggugcagcacuucuaccaagaagcggccccugcacagucggauguugcuuugcuacgguuugugaaccccgacacgggacguguccuguucgaguguaaacuccauaagucuggcuaugugacaguagcccacaccgggcagcacgaucuggugaucccaccgaacggauacuuucgcuucgacuccuggguuaaucaguucuauacucuugcaccuauggguaacggcaccgggagaaggcgggcccuguga

SEQ ID NO: 18156 - RNA, 1623 nt, Artificial Sequence; identical to SEQ ID NO: 18112
  derived and/or modified sequence opt3 from VP1__Norovirus__AER11324

SEQ ID NO: 18157 - RNA, 1623 nt, Artificial Sequence
  derived and/or modified sequence opt3 from VP1__Norovirus__AER11326
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuaccucgugccucccacaguagagucccggaccaaaccauuuacugugccuaucuuaacagucgaagagaugaccaacucucgcuuccccauaccacuggagaaacuuuuuacgggacccagcggugccuucgugguucagccucagaauggcagauguacuaccgacgggguguugcugggaacaacucaacuauccccagucaacauuugcaccuucaggggcgaugugacacauaucgcagguucacggaauuauaccaugaaccucgcuagucugaauuggaacaauuacgacccgacggaagagauucccgccccucuugggacuccagauuuuguaggaaagauccagggcguucugacacagaccacuaagggcgacgggagcacacgcggacacaaggcuaccguguacacggguggcgcccccuucaccccuaaauuggggucuguccaguuuuccacagacacugaaaacgauuucgagacccaucaaaauacaaaguuuacuccagugggagucauccaggacggcucaaccacacaccgaaacgaaccccagcaaugggugcucccgagcuauagugguagaaauguucacaacgugcaucuggccccugcaguagcuccaaccuuccccggggagcaguuacuguuuuucaggucuacuaugccuggcuguuccggauaccccaauauggaucucgacugccuucugccacaggaguggguccagcacuuuuaucaagaagcggccccugcacagagcgauguggcuuugcuacgguucguuaaccccgacacgggccgugugcuguuugaguguaaacuccauaagucgggguacgucacaguggcccacaccggacagcacgaucugguaauuccaccgaacgguuauuuccgcuuugacucuugggugaaucaguucuacacucuugcaccuaugggcaacgggaccggaagaaggcgggcccuguga

SEQ ID NO: 18158 - RNA, 1623 nt, Artificial Sequence; identical to SEQ ID NO: 18125
  derived and/or modified sequence opt3 from VP1__Norovirus__AER11328

SEQ ID NO: 18159 - RNA, 1623 nt, Artificial Sequence
  derived and/or modified sequence opt3 from VP1__Norovirus__AER11330
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagacucccgccccucuugggacaccagauuucguaggaaagauucagggcguucugacccagacuacaaagggcgacgggagcacccgcggacacaaggcuacgguguacaccgguucugcccccuuuacaccuaaauugggcuccguccaguucucaacugacaccgaaaacgauuuugagacacaucaaaauacuaaguucaccccagugggggucauccaggacggaagcacaacccaccgaaacgaaccccagcaaugggugcucccgaguuacucuggcagaaauguucacaacgugcaucuggccccugcaguagcuccaacuuuucccggugagcaguuacuguucuuuagguccacgaugccuggguguagcggcuaucccaauauggaucucgacugccuucugccacaggaguggguccagcacuucuaccaagaagcggccccugcacagucggauguggcuuugcuacgguuuguuaaccccgacacaggacgugugcuguucgaguguaaacuccauaagucuggcuaugucaccguggcccacacugggcagcacgaucugguaaucccaccgaacggauacuuucgcuucgacuccugggugaaucaguucuauacccuugcaccuauggguaacggcacagggagaaggcgggcccuguga

SEQ ID NO: 18160 - RNA, 1623 nt, Artificial Sequence; identical to SEQ ID NO: 17660
  derived and/or modified sequence opt3 from VP1__Norovirus__AER11332

SEQ ID NO: 18161 - RNA, 1623 nt, Artificial Sequence; identical to SEQ ID NO: 18125
  derived and/or modified sequence opt3 from VP1__Norovirus__AER11334

SEQ ID NO: 18162 - RNA, 1623 nt, Artificial Sequence
  derived and/or modified sequence opt3 from VP1__Norovirus__AER11336
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccagggcguucugacacagaccacuaaggccgacggcagcacacgcgggcacaaggcaaccguguacacgggaucugccgacuuuacccccaaauuggguuccguccaguucaauacagauacugaaaacgacuuugagacccaucaaaauacaaaguucacuccugugggcgucauccaggaugggucaaccacacaccgaaacgaaccacagcaaugggugcuccccagcuacaguggaagaaauguucacaacgugcaucuggcuccggcgguagcaccuaccuuuccaggcgagcaguuacuguucuuuaggucuacuaugcccgguuguuccggguauccuaauauggaccucgauugccuucugccccaggaguggguccagcacuucuaccaagaagccgcuccagcccagagcgacguggcauugcuacgguuuguuaacccugauacgggccgugugcuguucgaguguaaacuccauaagucgggauaugucacaguggcccacaccggccagcacgaccugguaauucccccaaacggguacuuucgcuucgauucuugggugaaucaguucuauacucuugcuccgaugggaaacgguaccggcagaaggcgggcccuguga

SEQ ID NO: 18163 - RNA, 1623 nt, Artificial Sequence
  derived and/or modified sequence opt3 from VP1__Norovirus__AER11340
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccagggcguucugacacagaccacuaaggccgacggcagcacacgcgggcacaaggcaaccguguacacgggaucugccgacuuuacccccaaauuggguuccguccaguucucaacagauacugaaaaugacuuugagacccaucaaaacacaaaguucacuccugugggcgucauccaggaugggagcaccacacaccgaaaugaaccacagcaaugggugcuccccaguuacucuggaagaaacguucacaaugugcaucuggcuccggcgguagcaccuaccuuuccaggcgagcaguuacuguucuuuagguccacuaugcccgguuguagcggguauccuaacauggaccucgauugccuucugccccaggaguggguccagcacuucuaccaagaagccgcuccagcccagucggacguggcauugcuacgguuuguuaauccugauacgggccgugugcuguucgaguguaaacuccauaagucuggauaugucacaguggcccacaccggccagcacgaccugguaauucccccaaacggguacuuucgcuucgauuccugggugaaccaguucuauacucuugcuccgaugggaaaugguaccggcagaaggcgggcccuguga

SEQ ID NO: 18164 - RNA, 1623 nt, Artificial Sequence; identical to SEQ ID NO: 18163
  derived and/or modified sequence opt3 from VP1__Norovirus__AER11342

SEQ ID NO: 18165 - RNA, 1623 nt, Artificial Sequence
  derived and/or modified sequence opt3 from VP1__Norovirus__AER11344
augaagauggccagcaacgacgcuucccccucugauggcucagcagccaaucuggugccugaggucaacaaugaaguuauggcgcucgagccagugguaggggcugccaucgcagccccgguggcuggacagaaaaacgucauugaccccuggauaagaaauaacuucgugcaagcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaagaucauuuucgccgcagugccuccaaauuuuccgacugagggccucucucccucgcagguaacgauguucccucauaucauaguugacgugcgccagcuggagccaguccuuaucccccugccugaugugcgaaacaauuuuuaucacuacaaccaaucaaaugacagcaccauuaaauugaucgcuaugcucuauacaccacugcgugccaacaacgcgggggaagauguguucacugucaguugcagaguucugaccaggcccuccccggacuuugauuucauuuuucucgugccucccacaguagagucucggaccaagccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucagcuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccaaggcguucugacacagaccacuaaggccgacggcagcacacgcgggcacaaagcaaccguguacacgggaucugccgacuuuacccccaaguuggguuccguccaguucucaacagauacugaaaaugacuuugagacccaucagaacacaaaauucacuccugugggcgucauccaagaugggagcaccacacaccgaaaugaaccacagcagugggugcuccccaguuacucuggaagaaacguucacaaugugcaucuggcuccggcgguagcaccuaccuuuccaggcgagcaauuacuguucuuuagguccacuaugcccgguuguagcggguauccuaacauggaccucgauugccuucugccccaggaguggguccagcacuucuaccaggaagccgcuccagcccaaucggacguggcauugcuacgguuuguuaauccugauacgggccgugugcuguucgaguguaagcuccauaaaucuggauaugucacaguggcccacaccggccagcacgaccugguaauucccccaaacggguacuuucgcuucgauuccugggugaaccaguucuauacucuugcuccgaugggaaaugguaccggcagaaggcgggcccuguga

SEQ ID NO: 18166 - RNA, 1623 nt, Artificial Sequence; identical to SEQ ID NO: 18163
  derived and/or modified sequence opt3 from VP1__Norovirus__AER11346

SEQ ID NO: 18167 - RNA, 1623 nt, Artificial Sequence
  derived and/or modified sequence opt3 from VP1__Norovirus__AER11348
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucuucgucacagguaacgauguucccccauaucauaguugacgugcgccaacuggagccuguccuuaucccacugcccgaugugcgaaacaauuuuuaucacuacaaccagagcagugacuccaccauuaaguugaucgcuaugcucuauacaccucugcgugccaauaacgcgggggaagauguguucacugucucuugcagaguucugaccaggccaagccccgacuuugauuucauuuuucucgugccgccuacaguagagucccggaccaaacccuucacugugccaaucuuaacagucgaagagaugaccaacucacgcuuuccuauaccccuggagaaacuuuucacgggaccaaguggugccuucgugguucagccccagaauggcagauguacuaccgacgggguguugcugggaacaacucaacuaagcccugucaacauuugcaccuuuaggggcgaugugacacauaucgcagguucucggaauuacaccaugaaccucgcugcccugaauuggaacaauuaugacccaacggaagagauuccggcuccccuugggacuccugauuucguaggaaagauccagggcguucugacacagaccacuaaggccgacggcuccacacgcgggcacaaggcaaccguguacacgggaucagccgacuuuaccccaaaauuggguagcguccaguucaguacagauacugaaaacgacuuugagacccaucaaaauacaaaguucacucccgugggcgucauccaggaugggucuaccacacaccgaaacgaaccucagcaaugggugcucccauccuacagcggaagaaauguucacaacgugcaucuggcucccgcgguagcaccgaccuuuccuggcgagcaguuacuguucuuuaggucgacuaugccagguuguucuggguaucccaauauggaccucgauugccuucugccucaggaguggguccagcacuucuaccaagaagccgcucccgcccaguccgacguggcauugcuacgguuuguuaacccagauacgggccgugugcuguucgaguguaaacuccauaagucaggauaugucacaguggcccacaccggccagcacgaccugguaauuccucccaauggguacuuucgcuucgauaguugggugaaccaguucuauacucuugcuccaaugggaaacgguaccggcagaaggcgggcccuguga

SEQ ID NO: 18168 - RNA, 1623 nt, Artificial Sequence
  derived and/or modified sequence opt3 from VP1__Norovirus__AER11350
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccaucuuaacagucgaggaaaugaccaacucccgcuuuccaauaccccuggagaaacuuuucacgggaccuucaagugcguucgugguucagccacagaaugguagauguacuaccgauggcguguuuuuggggacaacucaacugagcccggucaacauuugcaccuucaggggagacgugacacauaucaccggcucucggaauuacacgaugaaccuagccacucagaauuggaacuccuaugaucccacagaggaaauuccugcaccacucgguacccccgacuuuguagggaagauccagggaguucugacucagacaacccgcgcugacggcucaacgcgaggccacaaggccaccguguacacagggagcgcugauuucgccccuaaacuuggaagaguccaauuugcaacugacaccgauaaugacuucgaugccaaccagaauacaaaguuuacuccagugggugucauccaggacggcgauaccgcucauaggaacgagccccaacagugggugcugccgaguuacucugggcguaauucccacaacguucacuuggcgccugcaguggccccaacauuccccggagaacagcuccuguuuuuccggagcaccaugccuggcuguucggguuaucccaauauggacuuagauugccugcucccacaggaguggguacaauacuuuuaucaggaagcugccccugcacagucugacgucgcccuucugcgcuucgugaaccccgauacugggagaguuuuguuugaguguaagcuacauaaauccggcuacgugacggucgcucacacaggacagcaugaccuggugauuccaccgaauggcuauuucagguucgacucauggguaaaccaauuuuacacccucgccccuauggggaacggaacuggucggcgacgcgcacuguga

SEQ ID NO: 18169 - RNA, 1623 nt, Artificial Sequence
  derived and/or modified sequence opt3 from VP1__Norovirus__AER11352
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgauaaugacuuugaugccaaucagaacacaaaauucacuccagugggugucauccaggacggcgggaccgcucauaggaaugagccccaacaguggguguugccgagcuacaguggacggaacucucacaauguucaccucgcgccugcaguggccccaacauuucccggcgaacagcuguuauucuuucguuccaccaugccugguuguagcggguaucccaacauggaucuggacugccuccuuccacaggaguggguacaauacuucuaucaggaagcugccccugcacagucggaugucgcccuguugcgcuuugugaaucccgacacuggcagaguucuauucgaguguaagcugcauaaaucuggauacgugacggucgcucacacaggccagcaugaucucgugauuccaccgaacggguauuuuagguucgacuccuggguaaaccaauucuacacccuggccccuaugggaaaugguacuggccggcgacgcgcacuuuga

SEQ ID NO: 18170 - RNA, 1623 nt, Artificial Sequence
  derived and/or modified sequence opt3 from VP1__Norovirus__AER11354
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucgcaacagacacugagaacgauuuugaaacccaucaaaauacaaaguucacuccugugggcgucauccaggacgggagcaccacacaccgaaacgagccacagcaaugggugcccccgaguuacucuggaagaaauguucacaacgugcaucucgccccugcuguagcgccaaauuuucccggcgaacagcuguuauucuuuagguccaccaugccugguuguagcggguaucccaacauggaucuggacugccuccuuccacaggaguggguccagcacuucuaccaagaggcagccccugcucagucggauguggcccuguugcgguuuguuaaccccgacacuggccgugugcuauucgaauguaaacugcauaagucuggauaugucacgguggcacacacaggccagcacgaucucguaauuccaccgaauggguacuuucgcuucgacuccugggugaaccaguucuauacccuggccccuaugggaaaugguacuggcagaaggcgggcucuuuga

SEQ ID NO: 18171 - RNA, 1623 nt, Artificial Sequence
  derived and/or modified sequence opt3 from VP1__Norovirus__AER11356
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucgcaacagacacugagaacgauuuugaaacccaucaaaauacaaaguucacuccugugggcgucauccaggacgggagcaccacacaccgaaacgagccacagcaaugggugcuccccaguuacucuggaagaaauguucacaacgugcaucuggccccggcuguagcgccuaauuuuccaggcgaacaguuacuguucuuuagguccaccaugcccgguuguagcggguauccuaacauggaucucgacugccuucugccccaggaguggguccagcacuucuaccaagaggcagccccagcucagucggauguggccuugcuacgguuuguuaacccugacacuggccgugugcuguucgaauguaaacuccauaagucuggauaugucacgguggcacacacaggccagcacgaucugguaauucccccaaauggguacuuucgcuucgacuccugggugaaccaguucuauacccuugccccgaugggaaaugguacuggcagaaggcgggcucuguga

SEQ ID NO: 18172 - RNA, 1623 nt, Artificial Sequence; identical to SEQ ID NO: 17662
  derived and/or modified sequence opt3 from VP1__Norovirus__AER11358

SEQ ID NO: 18173 - RNA, 1623 nt, Artificial Sequence
  derived and/or modified sequence opt3 from VP1__Norovirus__AER11360
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucaucugaucguugacgugcgccaacuugagccaguccugauacccuugccugaugugcgaaacaauuuuuaucacuacaaccagucaaaugacagcacaaucaagcucauugcaaugcuguauacuccacugcgugcuaacaacgccggggaugacguguucaccgucaguugcagaguucucacaaggcccuccccggauuuugacuucaucuuuuuagugccucccaccguagaaucucggacuaaaccauucagcgugccuguccugacaguggaggaaaugaccaauucccgcuuucccauuccacuugagaaguuguucacgggacccucaagugcguucguugugcagccucagaacgguagauguacuaccgauggcguccugcuagggacaacucaacucagcccagugaauaucugcaccuuuaggggagacguaacacauauaccgggcucucggaacuacaccaugaaucuggccucccagaacuggaacucauaugaucccacggaggaaauuccugcaccacuugguacucccgacuucguugggaaaauccagggagugcugacacagaccacucgcacaaauggcagcacccgaggccacaaggcuacggucuacaccgggagugccgacuuuucuccuaaguugggaagagugcaauucgcuacagauacugacaaugauuuugagaccaaccagaauacaaaauucacuccagucggugugauucaggacggcuccaccacacccaggaacgaaccgcaacaguggguucucccuagcuacucggggcggaauauccauaacgugcaccuggccccagcaguagcccccaccuuuccuggagagcaguuacuguucuuucguucuacuaugcccggcuguuccgguuauccaaauauggaucucgacugccuucugccucaggaauggguccaauacuucuaucaggaggcugcgcccgcacagucagauguggccuugcuacgcuuuguuaacccagacacggggagagugcuguucgaguguaagcuccacaaaaguggcuacgucacaguggcucauaccggacagcacgaucugguaaucccgccuaacggcuauuuuagguucgacagcugggugaaucaauucuacacucuugcccccauggggaacggaaccggucggcgacgcgcacuguga

SEQ ID NO: 18174 - RNA, 1647 nt, Artificial Sequence
  derived and/or modified sequence opt3 from VP1__Norovirus__AEX10549
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaacggauaaucuuagugccgcgcagaucaccaugugcccgcaugugaucgucgacgugcggcaacuggaacccauuaacuugccuaugccagauguacgcaauaacuucuuucacuauaaccaggggagcgacucccgacuccgucugguugccaugcuguacacaccccucagagcaaauaacucuggagaugacguguucacugucucguguaggguguuaacccggccuucaccagauuuuagcuucaauuuucuggugcccccgacagucgagaguaagaccaaaccuuucacucuucccaucuugacaauuuccgaaaugucuaacagccgcuuuccaguuccuaucgacucccugcauaccucacccacggauaauauagugguacagugccagaacgguagagugacucuagacggcgagcucauggggaccacacaacugcuuccaagucagauuugugcuuucaggggaguccugacucggagcaccucucgcgccuccgaucaggcugacacagccacgccccgauuguucaauuaucacuggcauauccagcucgacaaccugaauggcaccccuuacgauccagcagaggacauuccggcccccuuagguacuccugauuuuagagggaagguguucggaguugcuucacaaaggaacccagacagcacaacccgggcgcacgaagcaaaaguggauacuacaaguggccguuuuacccccaagcugggcucucucgagaucuccacggaaagcggggacuucgaucagaaucagccuacccgcuuuacaccagucggaaucgguguggacaacgaggccgauuuccaacaguggacucuucccgacuauucgggccaguuuacccacaauaugaaccuggcuccggccguagcaccuaauuucccaggggaacaguugcuauuuuucagaucucaucugcccuccucaggaggcaggaguaacgguauucucgauugccugguuccucaagagugggugcagcacuuuuaccaggagagcgcccccgcucagacacaagucgcccuugugcgguacgucaacccagacacugggcgagugcuguucgaagcaaaguugcauaaacucggcuuuaugaccauagcgaaguccggagacucuccuaucacaguucccccaaauggcuauuuccgcuucgagagcugggugaacccguuuuacacccuggcuccuauggggacuggaaaugguagaaggcggauucaguga

SEQ ID NO: 18175 - RNA, 1623 nt, Artificial Sequence
  derived and/or modified sequence opt3 from VP1__Norovirus__AEX91910
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaacuccagcaccccuggguacaccugacuucguugggaagauccagggagugcuuacccagacuacacgcaccaauggcucaacgcgaggccacaaggcuaccgucuacacagggagcgccgacuuuaguccaaagcugggaagagugcaauucgcuacugauaccgacaaugauuuugagacaaaccagaauacuaaauucacccccgucggugugauucaggacggcucuacaaccccgaggaacgaaccucaacaguggguuuugccauccuacagcgggcggaauauccauaacgugcaccucgcccccgcaguagccccuacuuuucccggagagcagcuguuauucuuucguucgacgaugccaggcuguucugguuauccuaauauggaucuggacugccuccuuccccaggaauggguccaauacuucuaucaggaggcugcgccagcacaguccgauguggcccuguugcgcuuuguuaacccggacacagggagagugcuauucgaguguaagcugcacaaaucaggcuacgucaccguggcucauacuggacagcacgaucucguaaucccucccaacggcuauuuuagguucgacaguugggugaaucaauucuacacccuggccccaauggggaacggaacaggucggcgacgcgcacuuuga

SEQ ID NO: 18176 - RNA, 1737 nt, Artificial Sequence
  derived and/or modified sequence opt3 from VP1__Norovirus__AFD30970
augaagauggccagcuccgacgcuacccccucuucagauggcgcagggaaccuggugccugagagucagcaagaaguccucccacuugccccgguugcgggagcugcccuggcagcccccgugguaggucagcagaauaucauugacccuuggauaaaagagaacuucgugcaggcuccacaaggcgaauuuacagucagccccaaaaauuccccuggggagguguugguuaacuuagaacugucuccaagacuaaaucccuaccucgaucaccugucgaagauguauaacgcauacgccggaggcauggagguggagaucauucuugcugguaaugccuucacugcggggaagguccugaucgcagccgugccuccaaacuuuccgauugaaaauaucucagcuagccaggccagucaguucccccauguaauaguugacgugaggacguuggagccuauccggcucccacugcccgauguccgcaccaacuuuuuccacuauacaacucaggaggaaccucgaaugcguauuguggcauggcuguacaccccacucagaacaaauggauccggcgacgauucuuuuaccgugagcggcaggaucuuaacucggcccuccccggacuucgaguuuucauuccuggucccucccacaguugaaaccaaaacggugaguuuuagcguaccagggcuuguggucgaggauaugucuaacucccgcuggccugcucaaauuaauggauuggugguuagagguaacgaagcccaggugguccauuuccagaaugggaggugcacuaccgagggcacacugcuaggaacuaccacacucucaaucaacagcauauguggccugcggggucuuagugugucucaggcguccguacgcggggcccccgcacugaccgaagagaugccacccuuggaggacgaaguugcugauggagccgcugccacguauacucucgcacgagccgcugacacaacccugugguuaagaguggaggaaccugauggcaggccauacgacauuuuuggcgaccaaccggcgccccuggggacuccugauuucacagcagucaucgugggaaccgccauucggccacguacggcuagcggugccuaucuccacgacgcauacgucgauaccacacccggcgacgccgauuucacuccuucgaccgggaacacaaagaucgugcuucgcggaggcgguucugggcauguuggccagggacacuacuggcaguuuagaccaaucgcuguggagggcgggggauccaggccccaauaucaggaauacaaucugccggacuaugccgguccuacugcaucaaaccacgauuuggcgccacccguagcuccucggaugcccggcgagcuacugcuccuguucgagagugacaugccagucugggauaauggggccggagcagccccugcucagaagauucauugccuucugcccaacgaauuuauaacccacuuguucgaccuccaggccccagcacuggcugaggccgcguuacugcgauacgugcauccggauagcggccgcacacuauuugaauguaaacucuauagagaggguuacaugguuguggccgcuccugcagggaggcugaauuucccccuugacggcuauuuucgguucgacuccugggucucugccuuuuacaucuugagcccagugggaucaggccaagggcgcagaggaaggaguaaggcugccuga

SEQ ID NO: 18177 - RNA, 1623 nt, Artificial Sequence
  derived and/or modified sequence opt3 from VP1__Norovirus__AFH88383
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccugugcagggcauguuuaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcacacccuucauuccucuggaaagcccagcuccggugggguuucccgacuuaggagguugugauuggcacguaaauuucaccuuucaggcccaaaaccaggacccuagucagucuguuacguucgcuacuaaugaugccuccuuugugccauaucugggcagcaucucgccccauaacgggggagacuuccacgcaggcgauauuaucgguucucucggguggaucuccgccccuucagacaauagucagcuuaacgucuggacaauuccaaaguacggcagcucccugcccgaugugacccacuuggcuccggcggucuuuccuccaggauucggcgaggugauacuauauuuuuacucuacuuuccccgggagcggacaaccuucacagcugcagguucccugccuccugccacaggaauuuaucacacauuucuguaaugagcaagcaccuauugccggugaggcugcccuucugcacuauguggaccccgauaccggccgcaacuugggggaauuuaagcucuacccagacggauucaugacgugcguaccgaauagugucuccagcggcccucagacccugcccaucaacgguguguucguuuuugugucuugggucucacgauucuaccaguuaaaaccaguggggacagcaagugccgcuagaaggcugggccuacggcguauauga

SEQ ID NO: 18178 - RNA, 1671 nt, Artificial Sequence
  derived and/or modified sequence opt3 from VP1__Norovirus__AFJ21376
augaagauggccagcuccgacgcugcacccucuaccgauggcgccgggaaccuggugccugagucacagcaagaaguccucccacuugcgccgguugcuggagccgcacuggccgcucccgugguaggucagacaaauaucauugacccuuggauaaaagagaacuucgugcaggcaccacagggcgaauuuacugucagucccaagaauagcccuggggagaucuuggugaacuuagaacugggaccaaaacuaaaucccuaccucgaucaccuguccagaauguauaacucuuacgccggcgguauugacguuauggugguccuugcugggaaugccuucacggcgggaaaggugcugaucgcagccauuccuccaaacuuuccgguagagggcguuucggcuucacaagccacccaguucccccaugugaucauagaugucaggacauuggacccugugcggcucccacugcccgaugugcgcagcaccuuuuuccacuauacuaaugacacagagccuaaaaugcgacuggucaucuggcucuacaccccauuacguacuaacggcaguggggaugacuccuuuacaguuucuggaaggauucugaccagacccagccaggauuucgaauuugcauuccuuaucccgccuacgguggagacuaagaccacacccuuuuccguaccagguuucucagugcaggaaaugaguaauagccgguggccugcugccauuucugcgauggucgugcgcggcaacgagccccaaguugugcaguuucagaaugggagagcccauuuggacggaaugcugcuaggcacuaccccagucucccccaacuauaucgcaucauacagggguauaagcacagggaauagucggucugcuuccagcgaggccgaugaacgcgcugugggaucguucgacguauggguucgacuccaggagccugacggccaaccauaugauauuuucggcaagcagccggcccccaucgggaccccugacuuuaaagcagugauugucggauucgccgcuagaccacugacgucugguuccuacgcgaacgaagcauacgugaacacuacagccucagauuaugcucccgccaccggcaauaugagguuuacuguccggaacgggggaacaggccacaucagugcaaauaaguacugggaguucaaauccuuugguguggaaggggagcgucauaccgacauccaguaucaagaguacgaacuuccugauuauagcggccagguugccucuaaccacaaucuggcuccacccguggccccgcgcaugccuggagagagcuugcuccuguuccagucaaacaugccaguaugggacgauggccacggggaaaguacgcccaagaaaauucauugcuuacugccucaggaguuuauaggacacuucuuugacagacaagcacccucccucggugaugcggcccuucugagguacgucaaucaggaaaccaaccggguguuguucgaguguaagcuauaucgagacggcuacaucacaguugcugcaagcucugggcugcucgauuuuccacuggacggauucuuucgcuucgacucaugggugaguagcuucuacauucuuuccccugucggcucuggucaggggagaaggggccgggugcgcuuucaguga

SEQ ID NO: 18179 - RNA, 1608 nt, Artificial Sequence
  derived and/or modified sequence opt3 from VP1__Norovirus__AFJ21379
augaagauggccagcuccgacgcugcacccucuaacgauggcgccgcggggcuggugccugaggucaauaacgaaaccauggcucucgagccaguugccggagcaucaaucgccgcuccgcuuacaggucagaauaacgugauugaccccuggauaagacugaauuucguacaagcaccuaacggcgaauuuacugugaguccaaggaauagccccggggaggucuuguuaaaccuggaacuaggaccugagcucaauccauaccuggcccaccuuucccggauguauaacggcuacgcuggugggguggagguucaggugcuguuggccggaaaugcguucacggcaggcaaacucgucuuugccgcugugcccccucauuucccacuggaaaacaucucuccgggccagauuaccauguuuccccacguaaucauugauguucgcacacuggagccugugcucuuaccacugcccgacguccgaaauaacuucuuucauuauaaucagcaaaacgaaccucguaugagacuuguggccauguuguacacuccacugaggucgaacgggucaggagaugacguguucaccgucagcugccggguucuaacacgccccaguccggauuuugacuucaauuaucucgugccucccaccguagaguccaagacuaaaccauuuacacugccuauccuuaccaugggugagcugacgaacucuagauuccccgugccaauagaugaauuguacacuagccccaaugagucccucgucgugcagccucagaacgggaggugugcacuggacggcgaauuacagggaaccacacaacugcucccaacugcuaucugcucauuucggggccgcauuaaucagaagguuaguggugauaaccacguguggaauaugcaggucaccaacaucaaugggacaccguucgaccccaccgaggaugugccugccccacuuggaacgcccgacuucagcggcaaacuguuuggcguauugucucagcgagaccaugauaacgcguguagaucccacgacgccguuauugcaacuaauucagcuaaguucacaccuaagcuaggggccauccaaauaggaaccugggaacaggaugacgugcacauuaaccagccaacuaaauuuacacccgucggucuguucgagagcgagggcuuuaaucaauggacccucccgaacuauaguggggcucugacgcuuaauaugggacuggccccuccaguggcacccaccuucccuggcgaacagaucuuguuuuucaggucucauauuccccucaaggguggggucgccgauccagugaucgacugccuguuaccucaggaguggauccagcaccuguaccaagaauccgcucccagccagacagauguugcgcuaauucgguuuacuaacccagacaccggccguguacucuucgaggcaaaacugcaucgcucgggauacauaacaguggccaacacuggcucuagaccgaucgucgugccugcuaauggguauuuuagguucgauuccuggguuaaccaguuuuacucacuugcccccaugggaaccgguaauggccggcgacgcgugcaguga

SEQ ID NO: 18180 - RNA, 1608 nt, Artificial Sequence; identical to SEQ ID NO: 17868
  derived and/or modified sequence opt3 from VP1__Norovirus__AFJ21382

SEQ ID NO: 18181 - RNA, 1623 nt, Artificial Sequence
  derived and/or modified sequence opt3 from VP1__Norovirus__AFJ21387
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccaucuacacggguucugcccccuuuaccccuaaauugggcuccgugcaguucucaacagacacugaaaacgauuuugagacccaucaaaauacaaaguucacuccagucggggugauucaggacggaagcaccacacaccgaaacgaaccccagcaauggguccucccgaguuacucuggcagaaaugugcacaacguucaucuggccccugcaguggcuccaaccuuucccggugagcaguuacuguucuuuagguccacuaugccuggguguagcggcuaucccaauauggaucucgacugccuucugccacaggaguggguacagcacuucuaccaagaagcggccccugcacagucggaugucgcuuugcuacgguuugugaaccccgacacgggacguguucuguucgaguguaaacuccauaagucuggcuaugugacagucgcccacaccgggcagcacgaucuggugauaccaccgaacggauacuuucgcuucgacuccuggguaaaucaguucuauacucuugcaccuauggguaacggcaccgggagaaggcgggcccuguga

SEQ ID NO: 18182 - RNA, 1623 nt, Artificial Sequence; identical to SEQ ID NO: 18102
  derived and/or modified sequence opt3 from VP1__Norovirus__AFJ21388

SEQ ID NO: 18183 - RNA, 1623 nt, Artificial Sequence; identical to SEQ ID NO: 18112
  derived and/or modified sequence opt3 from VP1__Norovirus__AFJ21389

SEQ ID NO: 18184 - RNA, 1623 nt, Artificial Sequence
  derived and/or modified sequence opt3 from VP1__Norovirus__AFJ21390
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacgcuaugaaccucgccagccugaauuggaacaauuaugacccgaccgaagagauucccgcuccucuugguacgccagauuucguagggaaaauccagggacuguugacucagacaaccaagggcgacggcucuacucgcgggcacaaggccacaguuuacaccggauccgcacccuuuacgccuaaacucgguucagugcaguucagcaccgacacagaaaacgauuuugagacucaucaaaauaccaaguucacaccagucggcgugauccaggacgggaguacuacccaccgaaacgaaccccagcaauggguccugccgucuuacuccggaagaaaugugcacaacguucauuuagccccugcuguggcgccaacauuucccggcgagcagcuucucuucuuuaggagcaccaugccugguuguucgggguaucccaauauggaucuugacugccuguugccacaggaguggguacagcacuucuaccaagaagcagccccugcucagucugaugucgcccuacugcgguuugugaaccccgacacuggccguguucucuucgaguguaaacugcauaaguccggauaugugacggucgcacacacaggccagcacgaucuugugauuccaccgaacggguacuuucgcuucgacucauggguaaaucaguucuauacccuggccccuaugggaaacgguacuggcagaaggcgggcuuuguga

SEQ ID NO: 18185 - RNA, 1623 nt, Artificial Sequence
  derived and/or modified sequence opt3 from VP1__Norovirus__AFJ21391
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcagugacccaacaauuaaguugaucgcaaugcucuauacuccccugcgugcuaauaacgccggcgaugacguguucaccgucuccugcagaguucugacaaggccgucuccugauuuugacuucauuuuucucgugcccccaaccguagaaagccggacuaaaccuuucuccgugcccaucuuaacagucgaggaaaugaccaacucacgcuuuccaauaccccuggagaaacuuuucacggggccuaguagcgcguucgugguucagccacagaauggaagauguacuaccgaugguguguugcugggcacaacucaacuaucuccggucaacauuugcaccuuuaggggagacgugacacauaucgccgggacccaggaguacacgaugaaucucgcaucccagaacuggaauaacuaugaucccacugaagagauuccugcuccacugggcacacccgacuucguagguaagauccaggggguucuuacccaaacuacacggcgcgacggaucaacccgaggccacaaggccacggugagcaccggcaguguccauuuuacaccuaagcuggggagaauccaguucucuacugauaccuccaaugacuuugaaacaggacagaacacuagguucaccccagugggugucgugcaagauggcagcacaacccaccagaaugagccccagcaguggguuuugccgaacuacucggggcgggacucucacaaugugcaucucgcuccugccguagcaccauccuuucccggagaacaacuguuauucuuucguucaacuaugccuggcuguagugguuaccccaacauggaucuggacugccuccuuccacaggaguggguccagcacuucuaucaggaggccgcuccugcgcaaagcgauguggcacuguugcgcuuuguuaaucccgacacggggagagugcuauucgaauguaaacugcauaaguccggcuacgucacaguggcccacaccggacagcacgaucucguaauuccaccgaacggcuauuuuagguucgacucuugggugaaucaguucuacacucuggcuccuauggggaacggaaccggucggcgacgcgcccuuuga

SEQ ID NO: 18186 - RNA, 1623 nt, Artificial Sequence
  derived and/or modified sequence opt3 from VP1__Norovirus__AFJ21392
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaagauguguucaccgucaguugcagaguucugacaaggcccuccccggacuuugauuucauuuuucucgugccucccaccguagagucucggacuaaaccauucacagugccuaucuuaaccgucgaagagaugacgaauagccgcuuucccauaccacuggagaaacuuuucacuggacccuccggugcguucgugguucagccucagaacggcagauguaccacagacgggguguugcugggaacuacccaacuaucaccagucaauauuugcacauuuaggggcgaugugacccauaucgccgguagucggaacuacacgaugaaucucgcaagccugaacuggaauaacuaugacccgacugaagagauucccgcuccucuugggacaccagauuucguaggaaagauccagggcguucugacccagacuacaaagggcgacgggucuacccgcggacacaaggccacgguguacaccgguuccgcucccuuuacaccuaaauugggcucaguccaguucagcacugacaccgaaaaugauuuugagacacaucaaaacacuaaguucaccccagugggggucauccaggacggaaguacaacccaccgaaaugaaccccagcaaugggugcucccgucuuacuccggcagaaacguucacaaugugcaucuggccccugcaguagccccaacuuuucccggugagcaguuacuguucuuuaggagcacgaugccuggguguucgggcuaucccaacauggaucucgacugccuucugccacaggaguggguccagcacuucuaccaagaagcugcgccugcacagucugauguggccuugcuacgguuuguuaaucccgacacaggacgugugcuguucgaguguaaacuccauaaguccggcuaugucaccguggcucacacugggcagcacgaucugguaauuccaccgaacggauacuuucgcuucgacgccugggugaaccaguucuauacccuugcaccuauggguaauggcacagggagaaaaagggcccuguga

SEQ ID NO: 18187 - RNA, 1623 nt, Artificial Sequence; identical to SEQ ID NO: 18125
  derived and/or modified sequence opt3 from VP1__Norovirus__AFJ21393

SEQ ID NO: 18188 - RNA, 1623 nt, Artificial Sequence; identical to SEQ ID NO: 18112
  derived and/or modified sequence opt3 from VP1__Norovirus__AFJ21394

SEQ ID NO: 18189 - RNA, 1623 nt, Artificial Sequence; identical to SEQ ID NO: 18125
  derived and/or modified sequence opt3 from VP1__Norovirus__AFJ21395

SEQ ID NO: 18190 - RNA, 1623 nt, Artificial Sequence; identical to SEQ ID NO: 18112
  derived and/or modified sequence opt3 from VP1__Norovirus__AFJ21396

SEQ ID NO: 18191 - RNA, 1623 nt, Artificial Sequence
  derived and/or modified sequence opt3 from VP1__Norovirus__AFJ21397
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggauccaguccuuaucccccugccugacgugcgaaacaauuuuuaucacuacaaccagagcaaugauccaacaauuaaguugaucgcaaugcucuauacuccccugcgugcuaacaacgccggcgacgauguguucaccgucaguugcagaguucugacaaggccguccccugacuuugauuucauuuuucucgugcccccaaccguagagucucggacuaaaccuuucagcgugcccaucuuaacagucgaagagaugaccaauucccgcuuuccaauaccccuggaaaaacuuuucacggggccuucaagugcguucgugguucagccacagaacggaagauguacuaccgacgguguguugcugggcacaacucaacuaagcccggucaauauuugcaccuuuaggggagaugugacacauaucgccgggacccaggaguacacgaugaaccucgcaucucagaauuggaacaauuaugaccccacugaggaaauuccugcuccacugggcacacccgacuucguagguaagauccaggggguucuuacccaaacuacacggggagauggcuccacccgcggccacaaggccacggugucaaccgggagcguccauuuuacaccuaagcugggacgaauccaguucaguacugacaccucuaacgauuuugagacaggucagaauacuagauucaccccagugggcgucgugcaagacggguccacaacccaccagaacgaaccccagcaguggguuuugccgaauuacagcggaagggauucgcacaacgugcaucucgcuccugccguagcaccaucuuuucccggcgagcaacuguuauucuuucgguccacuaugccugguuguucaggguaccccaauaugaaccuggacugccuccuuccacaggaauggguccagcacuucuaucaggaggccgcuccugcgcaaagugauguggcacuguugcguuuuguuaaucccgacacgggccgcgugcuauucgaguguaaacugcauaagagcggauacgucacaguggcccacaccggccagcacgaucucguaauuccaccgaacggguauuuuagauucgacuccugggugaaccaguucuacacucuggcuccuaugggaaaugguaccggcaggcggcgagcccuuuga

SEQ ID NO: 18192 - RNA, 1623 nt, Artificial Sequence
  derived and/or modified sequence opt3 from VP1__Norovirus__AFJ21398
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagucuggcuaugucacaguggcccauaccgggcagcacgaucugguaauuccguccaacggauacuuucgcuucgacucaugggugaaucaguucuauacucuugcaccuauggguaacggcaccgggagaaggcgggcccuguga

SEQ ID NO: 18193 - RNA, 1623 nt, Artificial Sequence
  derived and/or modified sequence opt3 from VP1__Norovirus__AFJ21399
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccagggcguucugacacagaccacuaaggccgacggcagcacacgcgggcacaaggcaaccguguacacgggaucugccgacuuuacccccaaauuggguuccguccaguucucaacagauacugaaaaugacuuugagacccaucaaaacacaaaguucacuccugugggcgucauccaggaugggaauaccacacaccgaaacgaaccacagcaaugggugcuccccagcuacaguggaagaaauguucacaacgugcaucuggcuccggcgguagcaccuaccuuuccaggcgagcaguuacuguucuuuaggucuacuaugcccgguuguuccggguauccuaauauggaccucgauugccuucugccccaggaguggguccagcacuucuaccaagaagccgcuccagcccagagcgacguggcauugcuacgguuuguuaacccugauacgggccgugugcuguucgaguguaaacuccauaagucgggauaugucacaguggcccacaccggccagcacgaccugguaauucccccaaacggguacuuucgcuucgauucuugggugaaucaguucuauacucuugcuccgaugggaaacgguaccggcagaaggcgggcccuguga

SEQ ID NO: 18194 - RNA, 1623 nt, Artificial Sequence; identical to SEQ ID NO: 18192
  derived and/or modified sequence opt3 from VP1__Norovirus__AFJ21400

SEQ ID NO: 18195 - RNA, 1623 nt, Artificial Sequence
  derived and/or modified sequence opt3 from VP1__Norovirus__AFJ21401
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucgggacuacaccaugaaccucgcuagccugaauuggaacaauuaugauccgacggaagagacucccgccccucuugggacaccagacuucguaggaaagauucagggcaugcugacccagacuacaaagggcgacgggucuacccgcggacacaaggcuacgguuuacaccgguuccgcccccuuuacaccuaaauugggcucagugcgauucagcacugauaccgaaaacgacuuugagacacaucagaauacuaaguucaccccagucggggugauccaagauggaaguacaacccacagaaacgaaccccagcaguggguccucccgucuuacuccggcagggacgugcacaauguucaucuggccccugcaguggcuccaacuuuucccggugagcaauuacuguucuuucggagcacgaugccuggguguucgggcuaucccaacauggaucucgacugccuucugccacaggaguggguacagcacuucuaccaggaagcggccccugcacaaucugaugucgcuuugcuacguuuugugaaucccgacacaggacgcguucuguucgaguguaaacuccauaaguccggcuaugugaccgucgcccacacugggcagcacgaucuggugaucccaccgaacggauacuuuagauucgacucauggguaaaucaguucuauacccuugcaccuauggguaacggcacagggaggcggcgagcccuguga

SEQ ID NO: 18196 - RNA, 1623 nt, Artificial Sequence
  derived and/or modified sequence opt3 from VP1__Norovirus__AFJ21402
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucgggacuacaccaugaaccucgcuagccugaauuggaacaauuaugauccgacggaagagauucccgccccucuugggacuccagacuucguaggaaagauccagggcaugcugacacagaccacuaagggcgacgggucuacacgcggacacaaggcuaccguuuacacggguuccgcccccuuuaccccuaaauugggcucagugcgauucagcacagauacugaaaacgacuuugagacccaucagaauacaaaguucacuccagucggggugauccaagauggaaguaccacacacagaaacgaaccccagcaguggguccucccgucuuacuccggcagggacgugcacaauguucaucuggccccugcaguggcuccaaccuuucccggugagcaauuacuguucuuucggagcacuaugccuggguguucgggcuaucccaacauggaucucgacugccuucugccacaggaguggguacagcacuucuaccaggaagcggccccugcacaaucugaugucgcuuugcuacguuuugugaaucccgacacgggacgcguucuguucgaguguaaacuccauaaguccggcuaugugacagucgcccacaccgggcagcacgaucuggugauuccaccgaacggauacuuuagauucgacucauggguaaaucaguucuauacucuugcaccuauggguaacggcaccgggaggcggcgagcccuguga

SEQ ID NO: 18197 - RNA, 1623 nt, Artificial Sequence; identical to SEQ ID NO: 18196
  derived and/or modified sequence opt3 from VP1__Norovirus__AFJ21403

SEQ ID NO: 18198 - RNA, 1623 nt, Artificial Sequence; identical to SEQ ID NO: 18196
  derived and/or modified sequence opt3 from VP1__Norovirus__AFJ21404

SEQ ID NO: 18199 - RNA, 1623 nt, Artificial Sequence
  derived and/or modified sequence opt3 from VP1__Norovirus__AFJ21405
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucagcacagacacugagaacgauuuugaaacccaucaaaauacaaaguucacuccugugggcgucauccaggacgggaguaccacacaccgaaacgagccacagcaaugggugcuccccucuuacuccggaagaaauguucacaacgugcaucuggcaccggccguagcuccuaauuuuccaggcgaacaguuacuguucuuuaggagcaccaugcccgguuguucgggguauccuaacauggaucucgacugccuucugccccaggaguggguccagcacuucuaccaagaggcggcaccagcccagucugauguggcuuugcuacgguuuguuaacccugacacuggccgugugcuguucgaauguaaacuccauaagcccggauaugucacgguggcccacacaggccagcacgaucugguaauuccaccgaauggguacuuucgcuucgacuccugggugaaccaguucuauacccuugcaccuaugggaaauggugccggcagaaggcgggcucuguga

SEQ ID NO: 18200 - RNA, 1623 nt, Artificial Sequence; identical to SEQ ID NO: 17702
  derived and/or modified sequence opt3 from VP1__Norovirus__AFJ21406

SEQ ID NO: 18201 - RNA, 1623 nt, Artificial Sequence
  derived and/or modified sequence opt3 from VP1__Norovirus__AFJ21407
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccugggugagaaauaacuucguucaggcuccugguggcgaauuuacagugaguccaaggaaugcacccggggagauacuuuggagcgccccucugggaccagauuugaaccccuacuuaucccaccuggcucggauguauaauggcuacgccgguggguucgaaguccaggugauccuagcgggaaacgcauuuacugccggcaaaauuaucuucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccauuuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauugccggcagccacaacuacaccaugaaucucgcaucucagaacuggaacuccuaugaucccacggaggaaaucccugcuccacuggguacucccgacuucguugggaagauucagggagugcuuacacagaccacucggacagacggcucaacccgcggccauaaggccacggucuacaccgggagcacagaguuuaguccuaagcugggacgagugcaauucgcuacugauaccaauaaugacuuugaugccaaccagaauacaaaauucacuccagucggugugauccaggacggcgggaccacacacagaaacgaaccccaacaguggguuuugccgucuuacuccggaaggaauacccacaacgugcaucucgccccugcaguagcuccaacuuuucccggcgagcagcuguuauucuuucggagcacgaugccugguuguucgggguaucccaauauggaucuggacugccuccuuccacaggaauggguccaauacuucuaucaggaggcggccccugcacagucugauguggcucuguugcguuuuguuaaccccgacacaggccgcgugcuauucgaguguaagcugcacaaauccggauacgucaccguggcccauacuggccagcacgaucucguaaucccaccgaacggguauuuuagauucgacucaugggugaaucaauucuacacccuggcaccuaugggaaacgguacaggcaggcggcgagcccuuuga

SEQ ID NO: 18202 - RNA, 1623 nt, Artificial Sequence
  derived and/or modified sequence opt3 from VP1__Norovirus__AFJ21409
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgauaaugacuuugaugccaaucagaacacaaaauucacuccagugggugucauccaggacggcgauaccgcucauaggaaugagccccaacaguggguguugccgagcuacagugggcggaacucucacaauguucaccucgcgccugcaguggccccaacauuucccggagaacagcuguuauucuuucguuccaccaugccuggcuguagcgguuaucccaacauggaccuggauugccuccuuccacaggaguggguacaauacuucuaucaggaagcugccccugcacagucggacgucgcccuguugcgcuuugugaaucccgauacugggagaguucuauucgaguguaagcugcauaaaucuggcuacgugacggucgcucacacaggacagcaugaccucgugauuccaccgaacggcuauuuuagguucgacuccuggguaaaccaauucuacacccuggccccuauggggaauggaacuggucggcgacgcgcacuuuga

SEQ ID NO: 18203 - RNA, 1623 nt, Artificial Sequence
  derived and/or modified sequence opt3 from VP1__Norovirus__AFJ21410
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucguguucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccauuuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauugccggcagccacaacuacaccaugaaucucgcaucucagaacuggaacuccuaugaucccacggaggaaaucccugcuccacuggguacucccgacuucguugggaagauucagggagugcuuacacagaccacucggacagacggcucaacccgcggccauaaggccacggucuacaccgggagcgcugaguuuaguccuaagcugggacgagugcaauucgccacagauacuaauaaugacuuugaugcaaaccagaauaccaaauucacaccagucggugugauccaggacggcgggacuacccacagaaacgaaccccaacaguggguuuugccgucuuacuccggaaggaauacacacaacgugcaucucgccccugcuguagcgccaaccuuucccggcgagcagcuguuauucuuucggagcacuaugccugguuguucgggguaucccaauauggaucuggacugccuccuuccacaggaauggguccaauacuucuaucaggaggcagccccugcucagucugauguggcccuguugcguuuuguuaaccccgacacgggccgcgugcuauucgaguguaagcugcacaaauccggauacgucacaguggcacauaccggccagcacgaucucguaaucccaccgaacggguauuuuagauucgacucaugggugaaucaauucuacacucuggccccuaugggaaacgguaccggcaggcggcgagcucuuuga

SEQ ID NO: 18204 - RNA, 1623 nt, Artificial Sequence; identical to SEQ ID NO: 18203
  derived and/or modified sequence opt3 from VP1__Norovirus__AFJ21411

SEQ ID NO: 18205 - RNA, 1623 nt, Artificial Sequence; identical to SEQ ID NO: 18203
  derived and/or modified sequence opt3 from VP1__Norovirus__AFJ21413

SEQ ID NO: 18206 - RNA, 1623 nt, Artificial Sequence; identical to SEQ ID NO: 17702
  derived and/or modified sequence opt3 from VP1__Norovirus__AFJ21414

SEQ ID NO: 18207 - RNA, 1623 nt, Artificial Sequence; identical to SEQ ID NO: 18203
  derived and/or modified sequence opt3 from VP1__Norovirus__AFJ21415

SEQ ID NO: 18208 - RNA, 1623 nt, Artificial Sequence; identical to SEQ ID NO: 17702
  derived and/or modified sequence opt3 from VP1__Norovirus__AFJ21416

SEQ ID NO: 18209 - RNA, 1623 nt, Artificial Sequence; identical to SEQ ID NO: 18203
  derived and/or modified sequence opt3 from VP1__Norovirus__AFJ21417

SEQ ID NO: 18210 - RNA, 1623 nt, Artificial Sequence
  derived and/or modified sequence opt3 from VP1__Norovirus__AFJ21418
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacauuauagaccccuggaucagaaauaacuucguccaggcuccugguggcgaauuuacagugaguccaaggaaugcacccggggagauucuuuggagcgccccucugggaccagauuugaaccccuacuuaucccaccuggcucggauguauaauggcuacgccgguggguucgaaguucaggugauccuagcgggaaacgcauuuacugccggcaaaauugucuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcagccacaacuacaccaugaaucucgcaucucagaacuggaacuccuaugaucccacggaggaaauuccugcuccacuggguacucccgacuucguagggaagauccagggaguucuuacacagaccacucggacagacggcucaacccgcggccauaaggccacgguguacaccgggagcgcugaguuuaguccuaagcugggacgaauccaauucgccacagauacuaauaaugacuuugaugcaaaccagaauaccaaauucacaccagucggugugauucaggacggcgggacuacccacagaaacgaaccccaacagugggucuugccgucuuacuccggaaggaauacacacaacgugcaucucgccccugcuguugcgccaaccuuucccggcgagcagcuguuauucuuucggagcacucugccugguuguucgggguaucccaauauggaucucgacugccuucugccacaggaaugggugcaauacuucuaucaggaggcagccccugcucagucugauguagccuugcuacguuuugucaaccccgacacgggccgcgugcuguucgaguguaagcuccacaaauccggauacguuacaguggcacauaccggccagcacgaucuggucauaccaccgaacggguauuuuagauucgacucaugggugaaucaauucuacacucuugccccuaugggaaacgguaccggcaggcggcgagcucuguga

SEQ ID NO: 18211 - RNA, 1623 nt, Artificial Sequence
  derived and/or modified sequence opt3 from VP1__Norovirus__AFJ21419
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucaacuuucgugguucagccacagaacgguagauguaccacagauggcguguugcuggggacuacccaacuaaguccggucaauauuugcacauuuaggggagacgugacccauaucgcgggcagccacaacuacacgaugaaucucgccucucagaacuggaacuccuaugaucccacugaggaaauuccugcaccacuggguacacccgacuucguagggaagauccagggaguucuuacccagacuacacggaccgacggcucaacgcgcggccauaaggcuaccguguacacagggagcgccgaguuuaguccuaagcugggacgaguccaauucgcuacugauaccaauaaugacuuugaugccaaccagaauacaaaauucacuccagugggugucauccaggacggcgggaccacacacagaaacgaaccccaacaguggguguugccgucuuacuccggaaggaauacccacaacguucaucucgcuccugccguggcuccaacuuuucccggcgagcagcuguuauucuuucggagcacgaugccugguuguucgggguaucccaauauggaucuggacugccucauuccacaggaauggguacaauacuucuaucaggaggcggccccugcacagucugaugucgcacuucugcguuuugugaaccccgacacaggccgcguuuuguucgaguguaagcuacacaaauccggauacgugaccgucgcccauacuggccagcacgaucuggugauaccaccgaacggguauuuuagauucgacucauggguaaaucaauucuacacccucgcaccuaugggaaacgguacaggcaggcggcgagcccuguga

SEQ ID NO: 18212 - RNA, 1623 nt, Artificial Sequence; identical to SEQ ID NO: 18203
  derived and/or modified sequence opt3 from VP1__Norovirus__AFJ21420

SEQ ID NO: 18213 - RNA, 1623 nt, Artificial Sequence
  derived and/or modified sequence opt3 from VP1__Norovirus__AFJ21421
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucguguucgcuguaguuccuccaaauuuuccgacggagggccucucucccucacaggugaccauguucccucauauuaucgucgacgugcgccaacuggagccagugcuuauaccccugccugauguccgaaacaauuuuuaucacuacaaccagucgaaugacccaacaaucaaguugauugccaugcucuauacuccccugcgugcaaacaacgcuggggaugacguuuucaccgugagcugcagaguacugacaaggccgaguccugauuuugacuucaucuuucucgugcccccaaccgucgaaucccggacuaaaccuuucucugugcccauuuuaacaguugaggaaaugaccaauagccgcuuuccaaucccccuggagaaacuuuucacgggaccuuccucagccuucgugguccagccacagaacgguagauguacuaccgauggcguguugcuggggacaacucaacuaaguccgguaaauauaugcaccuuuaggggagacguuacacauauugcgggcagccacaacuacaccaugaaucucgccucucagaacuggaacuccuaugaucccacggaggaaaucccugcaccacuggguacucccgacuucguggggaagauucagggaguccuuacacagaccacucggacagacggcucaacccgcggccauaaggcuacgguguacaccgggagcgccgaguuuaguccuaagcugggacgaguccaauucgcuacagauacuaauaaugacuuugaugccaaccagaauaccaaauucacaccaguggguguuauccaggacggcgggacuacccacagaaacgaaccccaacaguggguguugccgucuuacuccggaaggaauacacacaacguacaucucgccccugcagucgcuccaaccuuucccggcgagcagcuguuauucuuucggagcacuaugccugguuguucgggguaucccaauauggaucuggacugccuccuuccacaggaaugggugcaauacuucuaucaggaggcggccccugcacagucugauguugcucuguugcguuuugugaaccccgacacgggccgcguccuauucgaguguaagcugcacaaauccggauacgugacaguagcccauaucggccagcacgaucucgugauuccaccgaacggguauuuuagauucgacucauggguuaaucaauucuacacccuggcaccuaugggaaacgguacuggcaggcggcgagcccuuuga

SEQ ID NO: 18214 - RNA, 1623 nt, Artificial Sequence; identical to SEQ ID NO: 18203
  derived and/or modified sequence opt3 from VP1__Norovirus__AFJ21422

SEQ ID NO: 18215 - RNA, 1623 nt, Artificial Sequence; identical to SEQ ID NO: 17698
  derived and/or modified sequence opt3 from VP1__Norovirus__AFJ21423

SEQ ID NO: 18216 - RNA, 1623 nt, Artificial Sequence; identical to SEQ ID NO: 17702
  derived and/or modified sequence opt3 from VP1__Norovirus__AFJ21424

SEQ ID NO: 18217 - RNA, 1623 nt, Artificial Sequence
  derived and/or modified sequence opt3 from VP1__Norovirus__AFJ21425
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaauaacuaugauccuacggaggaaaucccagcaccccuggguacuccugacuucguugggaagauucagggagugcuuacacagaccacucgcacaaauggcuccacccgaggccacaaggcuacggucuacaccgggucagccgacuuuagcccaaagcugggaagagugcaauucgcuacagauacugacaacgauuuugagaccaaucagaacacaaaauucacucccgucggugugauccaggacggcaguaccacaccgaggaaugaaccucaacaguggguuuugccaucuuacuccgggcggaacauccauaaugugcaccucgcccccgcaguagccccuaccuuucccggagagcagcuguuauucuuucguagcacuaugccaggcuguucggguuauccuaacauggaucuggacugccuccuuccccaggaauggguccaauacuucuaucaggaggcugcgccagcacagucugauguggcccuguugcgcuuuguuaacccggacacggggagagugcuauucgaguguaagcugcacaaauccggcuacgucacaguggcucauaccggacagcacgaucucguaauuccucccaauggcuauuuuagguucgacucaugggugaaccaauucuacacucuggccccaauggggaauggaaccggucggcgacgcgcacuuuga

SEQ ID NO: 18218 - RNA, 1623 nt, Artificial Sequence; identical to SEQ ID NO: 17702
  derived and/or modified sequence opt3 from VP1__Norovirus__AFJ21426

SEQ ID NO: 18219 - RNA, 1623 nt, Artificial Sequence
  derived and/or modified sequence opt3 from VP1__Norovirus__AFJ21428
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuucuggcucccggaacuacaccaugaaucucgccucacagaacuggaauagcuaugauccggcagaggaaauccccgcuccucuggguacgccagacuucguugggaagauucagggagugcuuacucagacaacccgcacuaacggcaguacacgaggccacaaggccaccgucuacacggggucugcugacuuuucccccaagcugggaagagugcaauucgccaccgauacagacaaugauuuugagacuaaccagaauaccaaauucacaccugucggugugauccaggacggcagcacuaccccaaggaacgaaccccaacaguggguuuugccgucguacucugggcggaauauccauaacgugcaccucgccccugcaguagcuccaacauuucccggagagcagcuguuauucuuucguuccaccaugccuggcuguucagguuaucccaauauggaucuggacugccuccuuccacaggaauggguccaauacuucuaucaggaggcggccccugcacagagugauguggcucuguugcgcuuuguuaaccccgacacugggagagugcuauucgaguguaagcugcacaaaagcggcuacgucacgguggcccauacaggacagcacgaucucguaauuccaccgaacggcuauuuuagguucgacuccugggugaaucaauucuacacccuggcaccuauggggaacggaacuggucggcgacgcgcccuuuga

SEQ ID NO: 18220 - RNA, 1623 nt, Artificial Sequence; identical to SEQ ID NO: 17702
  derived and/or modified sequence opt3 from VP1__Norovirus__AFJ21429

SEQ ID NO: 18221 - RNA, 1623 nt, Artificial Sequence; identical to SEQ ID NO: 17702
  derived and/or modified sequence opt3 from VP1__Norovirus__AFJ21430

SEQ ID NO: 18222 - RNA, 1623 nt, Artificial Sequence; identical to SEQ ID NO: 17702
  derived and/or modified sequence opt3 from VP1__Norovirus__AFJ21431

SEQ ID NO: 18223 - RNA, 1623 nt, Artificial Sequence
  derived and/or modified sequence opt3 from VP1__Norovirus__AFJ21432
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauacccccggcagccacaacuacacgaugaaucucgccucucagaacuggaacuccuaugauccuacugaggaaauuccagcaccccuggguacaccugacuucguugggaagauccagggagugcuuacccagacuacacggaccaauggcucaacgcgcggccauaaggcuaccgucuacacagggagcgccgacuuuaguccaaagcugggacgagugcaauucgcuacugauaccgacaaugauuuugagacaaaccagaauacuaaauucacccccgucggugugauucaggacggcucuacaaccccgagaaacgaaccucaacaguggguuuugccauccuacagcgggaggaauauccacaacgugcaccucgcccccgcaguagccccuacuuuucccggagagcagcuguuauucuuucggucgacgaugccaggcuguucugguuauccuaauauggaucuggacugccuccuuccccaggaauggguccaauacuucuaucaggaggcugcgccagcacaguccgauguggcccuguugcguuuuguuaacccggacacagggcgcgugcuauucgaguguaagcugcauaaaucaggcuacgucaccguggcucacacuggacagcaugaucucguaaucccucccaacggcuauuuuagauucgacaguugggugaaucaauucuacacccuggccccaauggggaacggaacagguaggcggcgagcacuuuga

SEQ ID NO: 18224 - RNA, 1623 nt, Artificial Sequence
  derived and/or modified sequence opt3 from VP1__Norovirus__AFJ21433
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacagugcaggagaugaccaauagccgcuuuccaaucccccuggaaaaacuuuucacgggaccuuccucagcguucguugugcagccacaaaacgguagauguacuaccgauggcgucuugcuggggacaacucagcuaaguccggugaauauaugcaccuuuaggggagacguaacacauauucccggcagccggaacuacaccaugaaucucgccucucagaacuggaacuccuaugauccuacggaggagaucccagcaccccuggguacuccugacuucguugggaagauucagggagugcuuacacaaaccacucgcacaaauggcucaacccgaggccacaaggcuacggucuacaccgggagcgccgacuuuaguccaaagcugggaagagugcaguucgcuacagauacugacaaugauuuugaaaccaaccagaauacaaaauucacucccgucggugugauccaagacggcucuaccacaccgaggaacgagccucagcaguggguuuugccauccuacagcgggcggaauauccauaacgugcaccucgcccccgcaguagccccuaccuuucccggagaacagcuguuauucuuucguucgacuaugccaggcuguucugguuauccuaauauggaucuggacugccuccuuccccaagaguggguccaguacuucuaucaggaagcugcgccagcacaguccgauguggcccuguugcgcuuuguuaacccggacacggggagagugcuauucgaguguaagcugcacaaaucaggcuacgucacaguggcucauaccggacaacacgaucucguaauuccucccaacggcuauuuuagguucgacaguugggugaaucaguucuacacucuggccccaauggggaacggaaccggucggcgacgcgcacuuuga

SEQ ID NO: 18225 - RNA, 1623 nt, Artificial Sequence
  derived and/or modified sequence opt3 from VP1__Norovirus__AFJ21434
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuucuggcucccggaacuacaccaugaaucucgccucacagaacuggaauagcuaugauccgacggaggaaauccccgcaccucuggguacuccagacuucguugggaagauucagggagugcuuacacagaccacucgcacaaacggcaguacccgaggccacaaggcuacggucuacaccgggucugccgacuuuucccccaagcugggaagagugcaauucgcuacagauacugacaaugauuuugagaccaaccagaauacaaaauucacuccugucggugugauccaggacggcagcaccacaccaaggaacgaaccccaacaguggguuuugccgucguacucugggcggaauauccauaacgugcaccucgccccugcaguagccccaaccuuucccggagagcagcuguuauucuuucguuccacuaugccuggcuguucagguuaucccaauauggaucuggacugccuccuuccacaggaauggguccaauacuucuaucaggaggcugcgccugcacagagugauguggcccuguugcgcuuuguuaaccccgacacggggagagugcuauucgaguguaagcugcacaaaagcggcuacgucacaguggcucauaccggacagcacgaucucguaauuccaccgaacggcuauuuuagguucgacuccugggugaaucaauucuacacucuggccccuauggggaacggaaccggucggcgacgcgcacuuuga

SEQ ID NO: 18226 - RNA, 1623 nt, Artificial Sequence; identical to SEQ ID NO: 17702
  derived and/or modified sequence opt3 from VP1__Norovirus__AFJ21436

SEQ ID NO: 18227 - RNA, 1623 nt, Artificial Sequence; identical to SEQ ID NO: 18225
  derived and/or modified sequence opt3 from VP1__Norovirus__AFJ21437

SEQ ID NO: 18228 - RNA, 1623 nt, Artificial Sequence
  derived and/or modified sequence opt3 from VP1__Norovirus__AFJ21438
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggaauauccauaacgugcaccucgcccccgcaguagccccuaccuuucccggagagcagcuguuauucuuucguucgacuaugccaggcuguucugguuauccuaauauggaucuggacugccuccuuccccaggaauggguccaauacuucuaucaggaggcugcgccagcacaguccgauguggcccuguugcgcuuuguuaacccggacacggggagagugcuauucgaguguaagcugcacaaaucaggcuacgucacaguggcucauauuggacaguaugaucucguaauaccucccaacggcuacuuuagguucgacaguugggugaaucaauucuauacccuggccccaauggggaacggaacuggucggcgacgcgcacuuuga

SEQ ID NO: 18229 - RNA, 1623 nt, Artificial Sequence; identical to SEQ ID NO: 17698
  derived and/or modified sequence opt3 from VP1__Norovirus__AFJ21439

SEQ ID NO: 18230 - RNA, 1623 nt, Artificial Sequence
  derived and/or modified sequence opt3 from VP1__Norovirus__AFJ21440
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcgcuaauggcucaacacgaggccacaaggccaccgucuacacggggagcgcugacuuuaguccaaagcugggaagagugcaauucgccaccgauacagacaaugauuuugagacuaaccagaauaccaaauucacacccgucggugugauccaggacggcucuacuaccccgaggaacgaaccucaacaguggguuuugccauccuacagcgggcggaauauccauaacgugcaccucgcacccgccguagcuccuacauuucccggagagcagcuguuauucuuucguucgaccaugccaggcuguucugguuauccuaauauggaucuggacugccuccuuccccaggaauggguccaauacuucuaucaggaggcggcaccagcccaguccgauguggcucuguugcgcuuuguuaacccggacacugggagagugcuauucgaguguaagcugcacaaaucaggcuacgucacgguggcccauacaggacagcacgaucucguaauuccucccaacggcuauuuuagguucgacaguugggugaaucaauucuacacccuggcaccaauggggaacggaacuggucggcgacgcgcccuuuga

SEQ ID NO: 18231 - RNA, 1623 nt, Artificial Sequence
  derived and/or modified sequence opt3 from VP1__Norovirus__AFJ21441
augaagauggccagcuccgacgcuaaccccucugauggcucaaccgcaaaucuggugccugaggucaacacagaaguuauggcccucgagccagugguaggggcggcuaucgccgcaccgguggccggacagcaaaaugucauugaccccuggauaagaaacaauuucgugcaggcuccugguggcgaauuuacuguuaguccaaggaacgcacccggggagauccuuuggagcgccccucugggaccagauuugaaucccuacuuaucccaccuggcucggauguauaacggcuacgccgguggguucgaagugcaggucauucuagcgggaaaugcauuuacggccggcaaaaucauuuucgcugccgugccuccaaacuuuccgaccgagggccucucucccucgcagguaacaauguucccucauaucauaguugacgugcgccaacuggagccaguccuuaucccccugccugaugugcgaaauaacuuuuaucacuacaaucagucaaacgacccaacuauuaaguugaucgcaaugcucuauacaccccugcgugcuaauaacgccggggaugacguguucaccgucagcugcagaguucugaccaggccgaguccugauuuugacuucauuuuucucgugcccccaacuguagaaucccggacaaaaccuuucucugugcccgucuuaaccguggaggaaaugacgaacagccgcuuuccaaucccccuggagaaacuuuucacuggaccuuccucagcguucguugugcagccacagaaugguagauguaccacagauggcgucuugcuggggacuacccaacuaaguccggugaacauaugcacauuuaggggagacguaacccauauucccggcagccggaauuacacgaugaaccucgccucucagaauuggaacuccuaugauccuacugaggaaaucccagcaccccuggguacaccugacuucguugggaagauucagggagugcuuacccagacuacacgcaccaauggcucaacgcgaggccacaaggcuaccgucuacacagggagcgccgacuuuaguccaaagcugggaagagugcaauucgcuacugauaccgacaacgauuuugagacaaaucagaacacuaaauucacccccgucggugugauccaggacggcucuacaaccccgaggaaugaaccucaacaguggguuuugccauccuacagcgggcggaacauccauaaugugcaccucgcccccgcaguagccccuacuuuucccggagagcagcuguuauucuuucguucgacgaugccaggcuguucugguuauccuaacauggaucuggacugccuccuuccccaggaauggguccaauacuucuaucaggaggcugcgccagcacaguccgaugccgcucuguugcgcuuugugaauccggacacagggagaguucuauucgaguguaagcugcacaaaucaggcuacgugaccgucgcccauacuggacagcacgaucucgugauuccucccaacggcuauuuuagguucgacaguuggguaaaccaauucuacacccuggcaccaauggggaauggaacaggucggcgacgcgcccuuuga

SEQ ID NO: 18232 - RNA, 1623 nt, Artificial Sequence
  derived and/or modified sequence opt3 from VP1__Norovirus__AFJ21442
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaucuuucacugugccaaucuuaacagucgaggaaaugaccaacagccgcuuuccuauaccccuggagaaacuuuucacgggaccauccucagccuucgugguucagccccagaaugguagauguacuaccgauggcguguugcuggggacaacucaacuaaguccugucaacauuugcaccuuuaggggagacgugacacauaucgcaggcagccggaauuacaccaugaaccucgcuucucugaauuggaacaauuaugauccaacggaggaaauuccggcuccccuugguacuccugacuucguagggaagauccagggaguucugacacagaccacuaagggcgacggcuccacacgcgggcacaaggccaccguguacacgggaucagccgauuuuaccccaaaauuggguagcguccaguucggcacagacacugauaacgacuuugagacccaucaaaauacaaaguucacucccgugggggucauccaggauggaaguaccacacaccgaaacgaaccucagcaaugggugcucccaucuuacuccggcagaaauguucacaacgugcaucuggcacccgccguagcuccgaauuuuccuggugagcaguuacuguucuuuaggagcaccaugccaggguguucgggcuaucccaacauggaccucgauugccuucugccucaggaauggguccagcacuucuaccaagaggcggcacccgcccagucugacguggcuuugcuacgguuuguuaacccagauacuggacgugugcuguucgaguguaaacuccauaaguccggcuaugucacgguggcccacacagggcagcacgaccugguaauuccucccaauggauacuuucgcuucgauucaugggugaaccaguucuauacccuugcaccaauggguaauggcgccgggagaaaaagggcucuguga

SEQ ID NO: 18233 - RNA, 1623 nt, Artificial Sequence
  derived and/or modified sequence opt3 from VP1__Norovirus__AFJ21443
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaugaucguugacgugcgccaacuggagccaguccuuauaccccugccugaugugcgaaacaauuuuuaucacuacaaccagucaaaugacccaacaaucaaguugauugcaaugcucuauacuccccugcgugcuaacaacgccggggaugacguguucaccgucagcugcagaguucugacaaggccgaguccugauuuugacuucaucuuucucgugcccccaaccguagaaucccggacuaaaccuuucucugugcccgucuuaacaguggaggaaaugaccaauagccgcuuuccaauuccccuggagaaacuuuucacgggaccuuccucagcguucguugugcagccacagaacgguagauguacuaccgauggcgucuugcuggggacaacucaacuaaguccggugaauaucugcaccuuuaggggagacguaacacauacccccggcagccacaacuacacgaugaaucucgccucucagaacuggaacuccuaugauccuacugaggaaauaccagcaccccuggguacaccugacuucguugggaagauucagggagugcuuacccagacuacacggaccaauggcucaacgcgcggccauaaggcuaccgucuacacagggagcgccgacuuuaguccaaagcugggacgagugcaauucgcuacugauaccgacaaugauuuugagacaaaccagaauacuaaauucacccccgucggugugauccaggacggcucuacaaccccgagaaacgaaccucaacaguggguuuugccauccuacagcgggaggaauauucacaacgugcaccucgcccccgcaguagccccuacuuuucccggagagcagcuguuauucuuucggucgacgaugccaggcuguucugguuauccuaauauggaucuggacugccuccuuccccaggaauggguccaauacuucuaucaggaggcugcgccagcacaguccgauguggcccuguugcguuuuguuaacccggacacagggcgcgugcuauucgaguguaagcugcauaaaucaggcuacgucaccguggcucacacuggacagcaugaucucguaaucccucccaacggcuauuuuagauucgacaguugggugaaucaauucuacacccuggccccaauggggaacggaacagguaggcggcgagcacuuuga

SEQ ID NO: 18234 - RNA, 1623 nt, Artificial Sequence
  derived and/or modified sequence opt3 from VP1__Norovirus__AFJ21444
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaccgccggcagccacaacuacacgaugaaucucgcaucucagaacuggaacuccuaugaucccacugaggaaaucccugcuccacuggguacacccgacuucguagggaagauucagggaguucuuacccagacuacacgggccgacggcucaacccgcggccauaaggcuacgguguacaccgggagcgccgaguuuaguccuaagcugggacgaguccaauucgcaacagauacugacaaugauuuugacgccaaucagaacaccaaauucacaccagugggugucauccaggauggcgggacuacccacagaaaugaaccccaacaguggguguugccgucuuacuccggaaggaacacacacaauguucaucucgcuccugcgguggcaccaaccuuucccggcgagcagcuguuauucuuucggagcacuaugccugguuguucgggguaucccaacauggaccuggauugccuccuuccacaggaauggguacaauacuucuaucaggaggccgcuccugcccagucugacgucgcacuguugcguuuugugaaucccgauacgggccgcguucuauucgaguguaagcugcacaaauccggauacgugacagucgcccauaccggccagcacgaccucgugaucccaccgaacggguauuuuagauucgauucauggguaaaccaauucuacacucuggcuccuaugggaaaugguaccggcaggcggcgagcccuuuga

SEQ ID NO: 18235 - RNA, 1623 nt, Artificial Sequence; identical to SEQ ID NO: 17702
  derived and/or modified sequence opt3 from VP1__Norovirus__AFJ21445

SEQ ID NO: 18236 - RNA, 1623 nt, Artificial Sequence
  derived and/or modified sequence opt3 from VP1__Norovirus__AFJ21446
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaguuccccuggagaaacuuuucacgggaccuuccucagcguucgugguccagccacagaacgguagauguacuaccgauggcguguugcuggggacaacucaacuaaguccgguaaauaucugcaccuuuaggggagacguuacacauauacccggcagccggaacuacaccaugaaucucgccucucagaacuggaacuccuaugauccuacggaggaaauuccagcaccccuggguacuccugacuucguggggaagauccagggaguccuuacacagaccacucgcacaaauggcucaacccgaggccacaaggcuacgguguacaccgggagcgccgacuuuaguccaaagcugggaagaguccaauucgcuacagauacugacaaugauuuugagaccaaccagaauacaaaauucacucccguggguguuauucaggacggcucuaccacaccgaggaacgaaccucaacaguggguguugccauccuacagcgggcggaauauccauaacguacaccucgcccccgcagucgccccuaccuuucccggagagcagcuguuauucuuucguucgacuaugccaggcuguucugguuauccuaauauggaucuggacugccuccuuccccaggaaugggugcaauacuucuaucaggaggcugcgccagcacaguccgauguugcccuguugcgcuuugugaacccggacacggggagaguccuauucgaguguaagcugcacaaaucaggcuacgugacaguagcucauaccggacagcacgaucucgugaucccucccaacggcuauuuuagguucgacaguuggguuaaucaauucuacacucuggccccaauggggaacggaaccggucggcgacgcgcacuuuga

SEQ ID NO: 18237 - RNA, 1623 nt, Artificial Sequence; identical to SEQ ID NO: 17702
  derived and/or modified sequence opt3 from VP1__Norovirus__AFJ21448

SEQ ID NO: 18238 - RNA, 1623 nt, Artificial Sequence
  derived and/or modified sequence opt3 from VP1__Norovirus__AFJ21451
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccguuucaccaaggaacgcccccggggagacacuuuggagugcuccucugggaccagauuugaaucccuacuuaagccaccuggcccggauguauaacggcuacgcggguggguucgaagugcaggucauccuagcaggaaaugccuuuacugcuggcaaaauuaucuucgccgcagugccuccaaacuuuccgacggagggccucucccccucucagguaaccauguucccucauauuaucguugacgugcgccaacuggagccaguccuuauaccccugccugaugugcgaaauaacuuuuaucacuacaaucagucgaacgacucaacaaucaaguugauugcuaugcucuauacuccacugcgugccaacaaugcgggggaugacguguucaccgucagcugcagaguucugacaaggcccaguccggauuuugacuucaucuuucucgugccucccaccguagaaucccggacuaaaccauucacagugccuauuuuaaccgucgaggaaaugacgaacucucgcuuucccaucccacuggagaaacuuuucacuggacccagcuccgccuucgugguucagccucagaaugguagauguaccacagauggcguguugcuggggacuacccaacuaucaccagucaacauaugcacauuuaggggagacgugacccauauugcaggcagucggaauuacacgaugaaccucgcuagccugaauuggaacaauuaugauccgacugaggaaauccccgccccucuugguacaccagacuucguagggaagauucagggaaugcugacccagacuacacagggcgacggcucuacccgcgggcacaaggcuacgguuuacaccggauccgccgauuuuacacccaaguuggguucagugcaauucgcaacugacaccgagaacgauuuugaaacacaucagaauacuaaauucaccccugucggcgugauccaggacgggagcacaacccaccgaaacgagccacaacagugggcccuccccaguuacucuggaagauccgcucacaauguccaucuggcgccggcaguggccccuaacuuuccaggcgaacaguuacuguucuuuaggagcacuaugcccgguuguucgggguauccuaauauggaucucgacugccuucugccccaggaguggguucaacacuucuaccaggaggcugccccagcacagucugauguggccuugcuacgguuuguaaacccugacacgggccguguccuguucgaauguaagcuccauaaauccggauaugugacaguugcucacaccggccagcacgaucuggugauucccccaaacggguacuuucgcuucgacucaugggucaaucaauucuauacucuugccccgaugggaaacgguaccggcagaaggcgggcacuguga

SEQ ID NO: 18239 - RNA, 1623 nt, Artificial Sequence
  derived and/or modified sequence opt3 from VP1__Norovirus__AFJ21454
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccagcucucggaacuacaccaugaaucucgccucccagaacuggaacucauaugauccuacggaggaaaucccagcaccccugggcacuccugacuucguugguaagauucagggggugcuuacacagaccacucgcacagacggaagcacccgaggccacaaggcuacggucuacaccggcagugccgauuuuucuccaaagcuggggagagugcaauucgcuacagacacugauaaugacuuugagaccaaucagaacacaaaauucacucccgucggagugauccaggaugguuccaccacacauaggaaugaaccgcaacaguggguuuugccuagcuacucgggccggaacauccacaaugugcaccucgccccagcaguagcccccaccuuuccuggggagcagcuguuauucuuucguucuacuaugcccggauguuccggcuauccaaacauggaccuggauugccuccuuccucaggaauggguccaauacuucuaucaggaggcugcgcccgcacagucagacguggcccuguugcgcuuuguuaauccagauacggguagagugcuauucgaguguaagcugcauaaaaguggguacgucacaguggcucacaccggccagcaugaccucguaauuccgccuaacggauauuuuagguucgauagcugggugaaccaauucuacacucuggcccccaugggcaaugggaccggacggcgacgcgcacuuuga

SEQ ID NO: 18240 - RNA, 1623 nt, Artificial Sequence
  derived and/or modified sequence opt3 from VP1__Norovirus__AFL70023
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuagcucaccuggcccggauguauaacggcuacgcggguggguucgaagugcaggucauucuagcaggaaaugccuuuacugcuggcaaaaucauuuucgccgcagugccuccaaacuuuccgacggagggccucagccccucccagguaaccauguucccucauaucguuguggacguccgccaacuggagccagugcuuauaccccugccugauguggggaauaacuuuuaucacuacaaucagucuaacgacccaacaaucaaguugauugcuaugcucuauacuccccugcgagccaacaaugcgggagaagaugucuucaccguuucgugccgugugcugacaagaccgucaccugacuuugauuucaucuuucucguacccccaaccguggagagcaggacuaaaccuuucacaguccccauuuuaaccguggaagagaugacgaacagucgguuuccaaucccccuggagaaacuuuucacugguccuuccggcgccuucguugugcagccacagaaugggcgcuguaccacagacggagucuugcugggcacuacccaacuaucuccggugaacauaugcacauuuagaggugauguaacccauauugcagggacgcacaauuacacuaugaaccucgcuagccagaauuggaacaauuaugaccccacagaagagaucccugccccacugggaacccccgauuucguuggcaggauucagggcaugcuuacucagacaacccgcggggacggauccacgcggggucauaaggcuaccgugucaacaggcgacguccacuuuacuccuaagcuggggaguauccaauucaacaccgauacaaauaacgacuuugaaacuggacagaauaccaaguucacaccagugggcgucgugcaggaugguaacggggcccaccaaaaugagccccagcaguggguuuugccgagcuacucuggccgaaccggacauaacgugcaccucgccccugcaguagcuccaacuuuucccggcgaacagcuguuauucuuuagauccacgaugccuggguguucaggauaccccaacaugaaucuggacugccuccuuccacaagaguggguccagcauuucuaucaggaggcggccccugcacagagcgauguggcucuguugagguuuguuaaccccgacacaggucgggugcuauucgaauguaaacugcacaagaguggcuacgucaccguggcccacacugggcaacaugaucucguaaucccaccgaauggauauuuucguuucgacucuugggugaaccaguucuacacccuggcaccuaugggcaaugguacagggcgcagaagggcccuuuga

SEQ ID NO: 18241 - RNA, 1653 nt, Artificial Sequence
  derived and/or modified sequence opt3 from VP1__Norovirus__AFN06724
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaucgacgccccguaugaggcugauugcaaugcuguacaccccucuccgggcuaauucaggcgaggauguguuuacagucagcugucgcguuuuaacuagaccagcccccgacuucgaguuuaccuuccuggugccgccuacaguagaaaguaagaccaaacccuuuacucuuccaaucuugacacugggcgagcuauccaacucuagguucccugcggccauugauaugcucuauaccgaccccaacgaaagcaucgugguccaaccacagaaugggcggugcacgcuggauggaacucuucaggguaccacacagcuggugcccacucaaauaugugcauuucgcggcaccuugauuucccagacagcucgagccgcugacucaaccgauaguccucagagagccagggaccacccacuccauguucaagugaagaaccuggaugggacgcaguacgacccgacugacgauauccccgcagucuuaggagccauugacuucaaaggcacaguguucgguguagcuagccagcgggauguuucugggcagcaagagcagggacacuaugcgacccgugcacacgaagcccauaucgacacuacagauccuaaguacgcuccaaagcugggcaccauccucauuaaauccgagucaaaugacuuuacgaccaaccagcccauacgcuucacaccugugggcaugggggauaauaacuggagacagugggagcuuccagacuacagcggaaggcugacuuugaauaugaaccuagcccccgcagucaguccgucuuuuccuggugaacggauccuguucuuucgauccauugugccaagcgccggcggguucggaucgggcuauaucgauugccucauaccccaagaguggguccagcacuuuuaccaggaagcugccccuucucaguccgcaguggcgcugguucgcuaugugaaucccgacaccgguagaaacauuuucgaggcuaaacuucauagggaaggguuucugacaguagccaauucaggcaacaauccaaucgucgugccucccaacggauacuuccgguuugaggcauggguuaaucaauucuauacuuuggccccaaugggcagugggcagggacgcagaagggcucaguga

SEQ ID NO: 18242 - RNA, 1653 nt, Artificial Sequence
  derived and/or modified sequence opt3 from VP1__Norovirus__AFN06725
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugauugcaaugcuguacaccccucuccgggcuaacucgggcgaggauguguuuacagucucaugucgcguuuuaacuagaccagcccccgacuucgaguuuaccuuccuggugccgccuacaguagaaagcaagaccaaacccuuuacucuuccaaucuugacacugggcgagcuaaguaacuccagguucccugcggccauugauaugcucuauaccgaccccaaugaaucuaucgugguccaaccacagaacgggcggugcacgcuggauggaacucuucaggguaccacacagcuggugcccacucaaauaugugcauuucgcggcaccuugauuagccagacagcucgagccgcugacuccaccgauucaccucagagagccagggaccacccacuccauguucaagugaagaaucuggaugggacgcaguacgacccgacugacgauauccccgcagucuuaggagccauugacuucaaaggcacaguguucgguguagcuagucagcgggauguuagcgggcagcaagagcagggacacuaugcgacccgugcacacgaagcccauaucgacacuacagauccuaaguacgcuccaaagcugggcaccauccucauuaaaucugaguccaacgacuuuacgaccaaucagcccauacgcuucacaccugugggcaugggggauaacaauuggagacagugggagcuuccagacuacucaggaaggcugacuuugaacaugaaucuagcccccgcagucagcccgaguuuuccuggugaacggauccuguucuuucgaucuauugugccauccgccggcggguucggaagcggcuauaucgauugccucauaccccaagaguggguccagcacuuuuaccaggaagcugccccuucgcagucugcaguggcgcugguucgcuaugugaaccccgacaccgguagaaauauuuucgaggcuaaacuucauagggaaggguuucugacaguagccaacuccggcaauaacccaaucgucgugccucccaauggauacuuccgguuugaggcauggguuaaccaauucuauacuuuggccccaaugggcucagggcagggacgcagaagggcucaguga

SEQ ID NO: 18243 - RNA, 1629 nt, Artificial Sequence
  derived and/or modified sequence opt3 from VP1__Norovirus__AFN06726
augaagauggccagcaacgacgcugcacccuccaccgauggcgccgcggggcuggugccugagucuaauucagaagucauggcucucgagccaguugccggagcagcccuugcugcaccggugacaggucagacuaacaucauugaccccuggauaagagccaauuucguacaagcuccuaacggcgaauuuacggugaguccaaggaaugcccccggggagguccuguugaacuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuuccccgugucuauagaucagauguacaccagcccaaacgaggucaucuccgugcagugucagaacgguagaugcacacuugacggcgaacugcaagggacuacccaguugcagguuucaggaauuugugccuuuaagggcgaggugacagcacaccuccaggauaaugaccaucuguauaacaucaccauuacgaauuuaaacgguagucccuucgacccuagcgaagauaucccagcuccgcuggggguccccgacuuccaaggaaggguguuuggcguaauaacucagcgggauaagcagaaugccgcuggccaaucucagccugccaaccgcgggcacgacgcaguugugccaacauacaccgcccaguacacucccaaacucggacagguccaaauugguacauggcagaccgaugaccuuaaggugaaucagccugucaaauucacgccagugggccugaacgauaccgagcacuuuaaucaguggguugugccccgauaugcuggggcguugaaccuaaauacaaaccuggcaccguccguagccccugucuucccaggagaaagacuccuguuuuucaggucauaccuuccccugaagggcgguuaugggaauccugcuaucgacugcuugcucccccaagagugggugcagcauuuuuaccaggaggccgcaccaagcaugagugaaguugcccuggugcgguauauuaacccugauacuggccgugcuuuauucgaggccaaacugcaccgcgcaggauuuaugaccgucucuuccaauacaagcgcgcccgugguagugccagcuaacggcuacuucagauuugacucguggguuaaccaguucuauucucuagccccgauggggacuggaaaugguaggcggcgaauccaauga

SEQ ID NO: 18244 - RNA, 1617 nt, Artificial Sequence
  derived and/or modified sequence opt3 from VP1__Norovirus__AFN06727
augaagauggccagcaacgacgcuacccccuccgaugacggcgcagccgggcuggugccugagaucaauaacgaagucauggcgcucgagccaguugcuggagccucuauugcagccccggugguaggucagcaaaauauaaucgaucccuggauuagaaacaauuucgugcaggcuccugcaggcgaauuuacagucucaccaaggaacagucccggggagcuucuguuggacuuagaacugggaccugagcuaaauccauaccucgcccaccuggcucggauguauaacggccaugccggugggauggaggugcagaucguucuugcgggaaaugcauucacugccggcaaaauucuguuugcugccauacccccuagcuucccauacgaaaacuuguccccggcacagcucacgaugugcccccacgugaucgucgaugugcgccaacuggagccuguacugcucccaaugcccgacauccgaaauguguuuuaucauuacaaccagaauaacucuccuaaguuacgucugguugcuaugcuuuauaccccauugagagccaauaacucgggcgaugacgucuucacagugucauguagggugcugacucggcccagcccggauuuucaguucaccuuucuagucccucccacaguugaaaguaaaaccaagaacuucacucucccagugcugcgcguauccgagaugacaaauucuagauuuccugugguccuugaccagauguacaccagcaggaacgagaauauuaucgugcaaccccagaacgggcggugcacgacugauggagaacuguuggguaccacaauucuccaguccguuucaaucuguaauuucaaaggcacuaugcaggcggagcugagugaccaaccacgcuaucaguaccaguuacaacugaccaaccucgaugggagccccauagacccuacagacgaugugccagccccgcuuggaacccccgacuuucaggcaaugcuguacggcgucgcuucucagcgauccucaagagauaaugccacgagggcucacgacgcccagauugauacugccggugacacauucgcaccuaagaucgggcaagugcgguucaagagcaguucuaacgauuuugacuugcaugauccaaccaaauucacucccauuggaguaaauguugacgaucagcacccuuuucgucaguggucccuaccaaacuauggcggccaccuggcucucaauaaccaucuggcgcccgcagugacaccgcuuuucccuggggaacagauccuguuuuuccgcagcuacaucccaucggccggaggucacaccgacggcgcuauggacugcuugcucccccaagaguggauugaacauuuuuaucaggagucugccccuucccagucagauauagcacuggucagauucaucaaucccgacacggggaggguguuauuugaggccaagcugcacaaacagggauuccuaaccauugcugccaguggcgaucacccaaucgucaugccuacaaacgguuacuuucgguucgaagcaugggugaaucccuuuuauacucucgcgccaguugggaccggcagcggacgacgcagaauacaauga

SEQ ID NO: 18245 - RNA, 1647 nt, Artificial Sequence
  derived and/or modified sequence opt3 from VP1__Norovirus__AFN06728
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguacacaccccucagagcaaauaacucuggagaugacguuuucaccgugucguguagggucuuaacucggccuucaccagauuuuagcuucaauuuucuggugcccccgaccguggagaguaagacaaaaccuuucacccuucccaucuugacuauauccgaaaugucuaacagccgcuuuccagucccuauugacucccugcauacaucacccaccgagaauaucguugugcagugccagaacgguagaguaacgcuagauggcgagcucauggggacuacccaacugcuuccaagucagauuugugcuuucaggggaacacugacucggagcaccucucgcgccuccgaccaggcugauacagccacgccccgauuguucaauuauuacuggcacauccagcucgacaaccugaauggcaccccuuaugacccagcagaagauaucccggcccccuuagguacuccugacuuuagagggaagguguucggagucgcuucacaaaggaacccagauagcacaacccgggcgcaugaggcaaaaguggacacuacaaguggccguuuuacccccaagcugggcucucucgaaauuuccacggagagcgaugacuucgauccuaaucagccaacccgcuuuacacccguugggauaggaguggacaacgaagccgauuuccagcaauggucgcuuccggacuacucuggucaguuuacucacaauaugaaccuggcuccugccgucgcaccaaauuuccccggcgagcaguugcuauuuuucagaucccagcugccuucaagugggggaaggagcaacggcauccucgauugccuggugccccaagaguggguacagcacuuuuaccaggaauccgccccagcucagacccaaguugcccuugugcgguaugucaacccugacacaggucgagugcuguucgaggcaaaguugcauaaacucggguuuaugacuauugcgaagaauggcgacucucccaucaccgucccaccgaacggauacuuccgcuucgaaagcugggugaauccuuuuuauacacuggcucccaugggcaccgggaacggaagaaggcggauacaguga

SEQ ID NO: 18246 - RNA, 1647 nt, Artificial Sequence
  derived and/or modified sequence opt3 from VP1__Norovirus__AFN06729
augaagauggccagcaacgacgcugcacccuccaaugauggcgccgcggggcuggugccugagaucaacaaugaagcuauggcccucgagccagucguuggagcagccauugcugcaccgcuuaccggucagcaaaacauaaucgaccccuggauuaugaauaacuucgugcaggccccuggcggggaauuuacaguaucuccaagaaauucacccggagaggugcuguugaacuuagaacugggcccugagaucaauccauaccuagcucaccucgccaggauguauaacgguuacgcagggggauucgagguccaggugguucuggcgggcaaugccuuuacugcuggcaaagugauuuucgccgcaauacccccuaacuuuccaaucgauaaucuuagugcugcccagaucacgaugugcccgcaugucauuguggacguacggcaacuggaacccaucaacuugccuaugccagauguucgcaauaacuucuuucacuauaaccaggggagcgacucccgacuccgucugauugcgaugcuguacacuccccucagagccaauaacucuggagaugacguguucacagucucguguaggguguuaacucggccuucaccagauuuuagcuucaauuuucuggugcccccgaccgucgagaguaagaucaaaccuuucacacuucccauauugaccauuuccgaaaugucuaacagccgcuuuccaguuccuaucgacucccugcauacuucacccacagagaauauugugguacagugccagaacgguagagugacccuagauggcgagcucauggggacgacucaacugcuuccaagucagaucugugcauucaggggaacccugacacggagcacuucucgcgcuuccgaccaggccgauaccgcuacaccccgauuguucaauuauuacuggcacauccagcucgacaaccugaauggcaccccuuaugacccagccgaagauauuccggcacccuuagguacgccugacuuuagagggaaggucuucggaguggccucacaaaggaacccagauagcacuacacgggcucaugaggcgaaaguugacaccaccaguggccguuuuacacccaagcugggcucucucgaaauauccaccgagagcggggauuucgacccuaaucagccaacgcgcuuuacccccgugggaaucggugucgauaacgaagcagacuuccagcaauggucgcuuccggauuacucuggccaguuuacacacaauaugcaccuggccccugcuguggccccaaacuuccccggggagcaguugcuauuuuucagaucccagcugccuucaaguggaggcaggagcaaugguauucucgacugccugguaccccaagaguggguucagcauuuuuaccaggaauccgcaccagcccagacucaaguggcucuuguccgguaugugaacccugauaccgggcgaguccuguucgaggccaaguugcacaaacucggcuuuaugacaaucgcaaagaacggagacucucccauaacugugccaccgaauggcuacuuccgcuucgaaagcuggguuaacccuuuuuauacccuggcgcccauggggacaggaaaugguagaaggcggauucaguga

SEQ ID NO: 18247 - RNA, 1644 nt, Artificial Sequence
  derived and/or modified sequence opt3 from VP1__Norovirus__AFN06730
augaagauggccagcaacgacgcugcacccuccaaugauggcgccgcgaaccuggugccugaagcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaggaugucuuuacaguuucaugucgcguguuaacuagaccagcccccgacuucgaguuuaccuuccugguaccgccuacaguggaaagcaagaccaaacccuuuacucuuccaauuuugacacugggcgagcuaaguaacuccagguucccugcgcccaucgauaugcucuauaccgacccaaaugaaacgauugucgugcaaccccagaacgggcggugcacucuggauggaacccuucaggguacaacucagcugguuccuacccaaaucuguucuuuucgcggcacauugauaagccagaccucccgaucagccgagaguacggacagcgcaccaagagugaggaaucacccgcuccauguccagcugaagaacuuagaugggacucccuacgacccuacagaugaagugccagcuguacugggagccauugacuucaaaggcaccguuuucgguguggcuucucaacggaauacuacaggguccucagccggagcaacccgugcccacgagguccacaucgacacgaccaacccccgcuauacaccuaagcucggcagcgugcuuauguacagugagucuacugauuuugacgauggccagccaaccagauucacacccauugggaugggagcugacgauuggaggcagugggaacugccggaguacuccggucauuugacucuaaauaugaaccuggcgccugcagucgccccagcuuuucccggcgaacggauccucuucuuucgaagcgugguuccuucggccgggggauauggcucuggucagaucgacugccugauuccccaagagugggugcagcacuucuaccaggaagcagccccaucccagucagcuguagcccuuauacgcuaugucaauccugauaccgggagaaacaucuuugaggcaaagcugcauagggagggcuucauuacaguggcgaauaguggaaacaaucccaucguugugccaccgaacggcuacuuucgguucgaggcuugggucaaucaauuuuauaccuugacuccuauggggacgggacagggucgcagaagggugcaguga

SEQ ID NO: 18248 - RNA, 1623 nt, Artificial Sequence
  derived and/or modified sequence opt3 from VP1__Norovirus__AFN06731
augaagauggccagcaacgacgcugcacccuccucugauggcgccgcggggcuggugccugagaucaauaacgaagucaugccacucgagccgguugcuggagccucacuugcaacccccgugguaggucagcaaaauauuauagacccuuggaucagaaacaauuucgugcaggccccagcuggcgaauuuacagucagucccaggaacagcccuggggagauucuguuggauuuagaacugggaccagagcuaaaucccuaccucgcacaccuggcccggauguauaacggccaugcuggugggauggaggugcagaucguucuugccggaaaugcguucacugcaggcaaaauuaucuuugccgcuauaccuccaggcuucccguacgaaaaccugucccccucucagaucacgaugugcccucacgugauuaucgacguccgccaauuggagccagugcuccugcccaugccugauauucgaaauaacuuuuuccauuauaaucaggggaacgacccaaagcugcgucucguagccauguuauacacaccccugagagcaaauaacucgggagaugacguuuuuaccgugucauguaggguccuuacuaaaccgagcccugauuucgaauuuaccuucuuggugcccccaacaguggagaguaagaccaaacaguuuacucugccuauccuaaagauauccgagaugacaaacucucgguuccccgucccaguugacgugauguauaccgcucgcaaugaaaaccagguagugcaaccccagaaugguagagucacgcucgauggcgagcugcuugggacuaccccucuguuggccgugaacauuugcaaguuuaaaggagaaguuaucgcgaagaauggcgacgugaggagcuaccggauggauauggagauuacaaacacugacgguaccccaaucgacccgacagaagauacccccgggccuaucggauccccagacuuccagggcauucucuucggcgucgccucacagcgcaauaaaaacgagcaaaaucccgcaacgcgagcucacgaggccaacauaaauacugggggagaucaguaugcuccuaagcuggcccaggugaaauuuuucagugaaagccaagacuuugagguacaucagccaacaaucuucacccccguugguguggcaggcgauacuucucacccguuuagacaguggacauuaccuagguacgggggacaccugaccaacaauacgcaucucgccccagcugucgcgccccuuuucccuggcgaacagcuguuguuuuuccggucccaaauucccucaagcggugggcacgagcagggcuacauggacugucuagugccacaggaauggguccagcauuuuuaucaagaggcagccaccgcucagagugagguggcccugauccguuucauaaacccugauacaggacgcguucucuuugaagcaaagcugcacaagcagggcuucauuacuguggcccacaccggggacaaucccaucguaaugccaccgaacggauacuuuagauucgaggcuugggucaaccaguucuauucucuugccccuguggguacaggcaaugggaggcggcgaguucaauga

SEQ ID NO: 18249 - RNA, 1623 nt, Artificial Sequence
  derived and/or modified sequence opt3 from VP1__Norovirus__AFN06732
augaagauggccagcaacgacgcugcacccuccaaugauggcgccaccgggcuggugccugagaucaaccacgaaacacucccacuugagccggucgcgggagcugccauugcagcccccguuacuggucagaauaacauaaucgacccuuggauuagaacgaauuucgugcaagcuccaaacggcgaauuuaccguaucucccaggaacucaccuggggagauccuguugaauuuagaacugggaccagaucuaaaucccuaccucgcacaucugagucggauguauaacggcuacgccggugggguggagguccaggugcuucuggcuggaaaugccuucacagcgggcaaaauuuuguuugcagccguuccuccaaacuucccgguggaguuucucagccccgcucagaucacuaugcugccucaccugauagucgacgugcgcacccucgaaccaaucaugauucccuuaccugauguacgaaauacauucuuucauuauaacaaucagccagccaaccguaugagacugguugcaaugcuuuacacccccuugagguccaacggcucuggggacgauguguucacugucucgugccgggugcugacacgcccgaccccugacuuugaguucacguaucuagugcccccaucagucgaaagcaagacuaaaccuuuuagucuccccauccugaccauuuccgagcuuacaaauucuagauucccagcucccaucgauagccuguacacugcccaaaacaauaacuugaauguucagugucagaacggaaggugcacccucgacggugagcugcagggcacaacccaauuacugccuuccgggauaugugcguuucggggaaagcucacggccgaugugcaccagucacaugacgaucgcuggcacaugcagcuuacuaaucugaacggcacaccauucgacccgaccgaagacguacccgcaccuuuggguacuccagauuucacagggcuacuguuuggaguggcuagucagcgaaaugucgugagcaaccccaauaccacgagagcccacgaggcuguuauuucuaccacauccucacaauucgugccuaaacucggcagcaucaacuuuggcaguacuucugacgauuuccagcugcagcaaccaaccaaguuuacacccgucgggauuaagguggaauccggacaugacuucgaucagugggcccuuccgagguauagcggucaccugacuuugaauaugaaccucgcaccuccaguagcccccaauuuuccuggcgagcagcuguuauucuuucggucgaacguucccugcgcugggggagugucugacggcgucaucgauugucugcuaccacaggaauggauccaacauuucuaccaggaguccgcgccuucacagagugacguggcacucauucguuacgucaaccccgauaccggucgcacacuguuugaggccaaacuucacagaaccggguauauaacuguggcucacagcggcgacuacccauugguugugccguccaauggauauuucagguuugauucuuggguaaaccaguucuacagccuggccccuaugggcacggggaauggacggcgacgcguccaauga

SEQ ID NO: 18250 - RNA, 1623 nt, Artificial Sequence
  derived and/or modified sequence opt3 from VP1__Norovirus__AFN06733
augaagauggccagcaacgacgcugcacccuccaaugauggcgccgcggggcuggugccugagucuucaaacgaagcuauggcccucgagccagucguuggagcaagucuugccgcuccggugaccggucagacaaauaucauugaccccuggauaagaacuaacuucguacaagcaccuaauggcgaauuuacggugagcccaaggaacucccccggggagguccuggugaauuuggaauuaggaccugagcugaacccauaccuagcccaccucgcuaugauguauaauggcuacgccggugggauggagguucaggugcugcuugcgggaaacgcauucaccgccggcaaaaucauuuuugcugccgugcccccuuauuucccaguggaaaaucugucuccgucgcagaucacaauguuuccccauguaauuaucgauguucggacuuuggagccugugcuccugccaaugcccgacguccgcucaacccuguuccacuuuaaccagaaggaugaaccuaaaaugcgacucguggcaauguuauacacaccacugcguagcaauggcaguggggacgauguguucaccgucuccugcagaauacuuacuaggcccucuccggaguuugacuucacauauuugguuccucccaccguggagagcaagacgaaaccauuuacucugccuguacuaacccucggagaacuguccaacucacgguucccccuuaguaucgaugagauggugacaagcccaaaugaaucuauugucgugcaaccccagaacggucgcguuacucuggacggcgaguugcucgggaccacacagcugcaggcuuguaacaucugcuccauuagaggaaaggugaccggccaagucccuaaugaacagcauauguggaacuuagagaucacgaaucugaacgguacucaguuugauccaacagacgaugugccggcccccuuggggguaccugacuucgcgggagagguuuucggcgugcuuucacagaggaaucggggcgaaagcaacccagccaaucgcgcacacgacgcugucguggccaccuacagugauaaguauacucccaaacugggguugguccaaauaggaacauggaacaccaaugacguggagaaccagccuacgaaguuuaccccaauuggucuaaaugaaguugcuaacggccaucgauucgagcaguggacacugcccagauacucuggggcccucacucugaauaugaaccuugcaccggccguggcuccucuguuuccaggagaaaggcuccucuucuuucgguccuacguaccccugaaaggcgguuucgggaauccugcgaucgauuguuuagucccccaagagugggugcagcacuuuuaucaggagagcgcaccaucgcugggcgacguugcccuagugcguuacgucaacccugauaccggacgcguccucuucgaagcuaagcugcacaaaggcggguuucuuacaguaucuuccacuucaaccggacccgugguugucccagccaacgguuauuucagauuugacaguugggugaaucaguucuacagcuuggcaccgaugggcacagggaacggaaggcggcgauuucaauga

SEQ ID NO: 18251 - RNA, 1623 nt, Artificial Sequence
  derived and/or modified sequence opt3 from VP1__Norovirus__AFN06734
augaugauggccagcaaggacgcucccaccuccccugauggcgcaucuggggccggacagcuggugccagaagcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguuccauaauucuucgcagccucaaccaacuaugcgucucguagcuauguuauauacaccccugagaaccgggggagguucaggcgggacggaugccuuuguuguggcgggaaggguccuuacuugcccugccccagacuucagcuuuuuguuccuggugcccccgaguguggagcagaagacccgggucuuuuccguuccuaacgugccccuaaaagaucucucuaauagccgcguaccagugccuauucagggcauguucaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcacacccuuuauuccucuggaaagcccagcuccggugggguuccccgacuuaggagguugugauuggcacguaaauuuuaccuuccaggcccaaaaccaggacccuagucagucuguuacguuugcuacuaaugaugccuccuucgugccauaccugggcagcaucucgccccauaacgggggagacuuucacucuggcgauauuaucgguucccucggguggaucucagcaccuagugacagcucccagcuuaaugucuggacaauuccaaaguauggcucuagccugcccgaugugacccacuuggccccggcugucuucccuccaggauuuggcgaggugauacuauacuuccauucaacuuuucccgggaguggacaaccuggucagcugcagguucccugccuccugccacaggaguucaucacacacuuuuguaacgaacaagcgccuauugcaggcgaggccgcccuucugcauuauguggaccccgauaccgggcgcaauuugggagaguucaagcucuacccagacggcuucaugacgugcguaccgaacuccgucagcucugguccucagacccugcccaucaaugggguguuuguuuucgugucaugggucagucgauuuuaucaguuaaaaccagugggcacagcuagcgcagccagaaggcugggacuacggcguauauga

SEQ ID NO: 18252 - RNA, 1632 nt, Artificial Sequence
  derived and/or modified sequence opt3 from VP1__Norovirus__AFN06735
augaugauggccagcaaggacgcuucccccucugcagauggcgccaacggggcgggacagcuggugccugaggucaauaacgcugaaccacucccgcuugaccccguugccggugcaucaaccgcccuggcuacagcaggccaagugaauaugaucgauccuuggauuuucaacaauuuuguacaggccccacagggggaguucacuauaagucccaacaauacgccuggagacaucuuguuugauuuacagcugggcccacaccuaaaccccuuccucgcucaucugagccaaauguacaaugguuggguggggaacaugagagucagggugauucuugccggaaaugcguuuaccgcaggcaaaguuaucauuugcugugugccuccaggcuuccagucccggacacugucuaucgcccaggcuacuuuguuuccgcacauaaucgccgacguccgcacccucgaacccauugagaucccucuggaagaugugcgaaacacacuguaucauaccaaugacaaccagccaacuaugcgucucuuaugcaugcuguacacaccccuuagaaccgggggagguucgggcgggacggaugcauucguaguugcuggaaggguguugacuuguccuucaagcgacuuuaauuuccuguuucuagucccacccaccguggagcaaaagacacggccguucagugugccuaacauuccccuccagcugcuuuccaacucucgcgucccaaaucugauccagagcaugguuuuguccccugaucaggcccaaaacgugcaguuucagaauggcagaugcacuaccgacggucaacuccuggggacaacccccguaucagugagucagauauuaaaauucaggggaaaggucagcgcgggcucucgggugauuaaccugacggagcucgauggcuccccauuccuugccuuugaagcacccgcuccuacuggguucccagaccugggaacaucagacuggcacguugagaugagcuugaauaguaacucucaguccagcgguaauccgauccuacugcgcgauauucagcccaacucgucugacuuugugccucaucucggcuccgucucagugaccacugccaucgauguagcuggggacuauacaggaaccauccaauggacgagucagccaagcaauguuacccccgugccugaugucaacuucuggacaauuccacaguacggcuccaaucuggccgaagcaucucagcuugcccccguggucuauccgccugguuuuggggaggcuauaguguacuucaugagcccaauccccggcccuaacacugcgcacaaacccaaucugguuccauguuugcucccucaagaguuugugacccacuucguaucagaacaggcacccaguaugggagaggccgcucugguccauuauguggacccagauacaaaccgaaauuuaggcgaauuuaagcuguacccggagggguucauuacuugcguuccuaacggaaccgguccccagcagcuaccacucaacggcguguuugucuucgccuccugggugagcagauuuuaccaacugaagcccguagggacagcaucuucagccaggggacggcuuggcgugcgucgcuga

SEQ ID NO: 18253 - RNA, 1635 nt, Artificial Sequence
  derived and/or modified sequence opt3 from VP1__Norovirus__AFN06736
augaugauggccagcaaggacgcucccaccaacauggauggcacauccggggcaggacagcuggugccugaggccaauacugcggaaccaaucucuauggacccggucgcuggugccgcaacggccguugcuaccgcaggccaaauuaacaugauagaucccuggaucaugucaaauuucgugcaggccccucagggggaguuuacaguaaguccaaacaauacucccggagacgugcuguucgaucuucagcugggcccucaauugaacccauuuuuagcucaccuggcccagauguacaaugguugggucgggaacaugagagugaaaguucuacucgcgggaaaugcauucaccgccggcaagauuaucauuagcugcauacccccuggcuuuacaucccagaacaucucuaucgcucagaugaccauguucccacaugugauugccgacgucagggugcuggaaccgaucgagauuccccuugaagauguacggaauguucuguuucacacuaacgacaaucgcccuacaaugcgauugguguguaugcucuauaccccacugcgugcaaacgggucgucaagcggaacggaucccuucgucaucgcugguagagugcugacuugcccugacaguaauuuuuccuuccucuuuuuagugccacccaacgucgagcagaaaaccaggccguucucuguuccuaacauaccccugaauacacuuagcaacucccgggugccaucauugauuaagaguaugacuaucagccgcgaucaaaaucagauuauccaguuucaaaacggcagaguaacccuggacgggcagcuacagggaacaaccccuacgucugugucccaacucuguaaaaucaggggcacuacauaccaugccaccggugggaauggaauuaaccugacugagcuuaauggcgaacccuaucacgcguucgagucaccagcccccauaggcuucccugaucucgggggaugcgacuggcauuugacagcaaccccaacgcaggcuuuuaacgacggugccaaggucgugcggcucagcguuacccagggcgcugccuucgcaccgcaccuggggacaauccacuacacuaccacagaucaugacuaugaucccaauaccaguauuaucuguacuuuagacuggcugucucagacaaccggacaaaacaauguggauccuuggcagauaccaacuuacggcuccacgcucacagaagccgcucagcuugcgcccccuauuuuuccacccgguuucggggagacccuggucuuuuucuugagcgacuuuccgaucucgaacggcaagaauggacuaucugugccuugcacucugccacaggaguucguaacccacuuuguuaacgaacaagcacccauccgcggcgaggccgcucuccugcauuauguggauccugacacacaccgaaaucuuggggaguucaaacuguaccccgaaggauuuaugaccugugucccaaacacuuccgguggcgggccucagacauugcccauuaacggaguguucgucuuugugucauggguuaguagauucuaccagcucaagccagugggcacggccggugcagccaggcggcuggggauccgucgcagcuga

SEQ ID NO: 18254 - RNA, 1635 nt, Artificial Sequence
  derived and/or modified sequence opt3 from VP1__Norovirus__AFN06738
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauauucucuuugaccuucagcugggcccucacuugaauccauucuuaagucaucuggcccaaauguauaacgguuggguagggaauaugaaagugaagguccuacucgcgggaaacgcauuuaccgccggcaaaaucauuaucagcugcauacccccuggcuucgcuucccagaauaucucuauugcccaggcaacaauguuuccacacgugaucgcugauguuagagugcuggaaccgauugaagucccccuugaggacgugaggaacguacuguuccauaauaacgauaauaccccuacuaugcgguugguuuguaugcucuacacaccacugcgcgccucggggucaagcaguggaaccgaccccuuugugaucgcgggucgaguccugacgugcccuuccccagauuucucuuuucucuucuuagugcccccgaacguggagcagaagacuaaaccuuuuagcguccccaaccugccacuuaauguuuuguccaacucacgugugccuagucugauaaaguucaugaugguaagccaagaccacggccagauggugcaguuucagaaugggagagucacccuagauggacaacuccagggcacaacucccaccucugccucccagcuguguaagaugagggguacaguguaucaugcaucagggggacaaggccuuaaccugaccgaaauugacggcacgccauaccacgcuuucgagagccccgccccuaucggguucccagauuugggagacagugacuggcacauuaaugcuucuccggccacuacauuuaacaccggugaauccguuaaacggcucgauauggagcagggcagcucguucgcaccccaucuggggacugugcacuauacaaaugccgacuacgaugcuaacaccgacuuaaucugcucucuggaguggcucuccccuccaucaggaggcacgcccaauaaggucaacccuugggcgaucccacgcuaugguaguacccuuacagaagcagcccagcuggcucccccgauuuacccuccaggguuuggcgaggccauaguguucuuuaugagcgauuuccccaucgcaaauggacaggacggcuugaaaguaccuuguacuauuccccaagaauuuguuacccauuucgugaacgagcaggccccaacaagaggggaagcugcccuacugcacuacgucgauccugacacucacaggaaucucggagaguuuaagcuguaucccgaggguuucaugaccugcgugccaaacuccucuggcagcgggccgcagacacuuccuaucaauggagucuuuaccuucgugucauggguuagucgguuuuaccagcugaaacccgugggcacuacggguccaguacgccgauuggggauaagaagguccuga

SEQ ID NO: 18255 - RNA, 1635 nt, Artificial Sequence
  derived and/or modified sequence opt3 from VP1__Norovirus__AFN06739
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauauucucuuugaccuucagcugggcccucacuugaauccauucuuaagucaucuggcccaaauguauaacgguuggguagggaauaugaaagugaagguccuacucgcgggaaacgcauuuaccgccggcaaaaucauuaucagcugcauacccccuggcuucgcuucccagaauaucucuauugcccaggcaacaauguuuccacacgugaucgcugauguuagagugcuggaaccgauugaagucccccuugaggacgugaggaacguacuguuccauaauaacgauaauaccccuacuaugcgguugguuuguaugcucuacacaccacugcgcgccucggggucaagcaguggaaccgaccccuuugugaucgcgggucgaguccugacgugcccuuccccagauuucucuuuucucuucuuagugcccccgaacguggagcagaagacuaaaccuuuuagcguccccaaccugccacuuaauguuuuguccaacucacgugugccuagucugauaaagagcaugaugguaucucaagaccacggccagauggugcaguuccagaaugggagagucacccuagauggacaacuccagggcacaacucccaccuccgccucacagcuguguaagaugagggguacaguguaucaugcaagcgggggacaaggccuuaaccugaccgaaauugacggcacgccauaccacgcuuuugagagucccgccccuaucggguucccagauauuggagacucugacuggcacaucaaugcuuccccggccacuacauucgauagcggugaaucgaucaaacgguuggacauggagcaggggucuuccuuugcaccccaucucggcaccguucacuauacuaacgccgauuacccugcuaauacagaccugauuugcucauuagaguggcugaguccacccagcggaggcaccccuaacaaggugaauccauggacgauaccccgcuaugguuccacccucacagaagcggcacagcuugccccgccuaucuacccacccggguucggcgaggcuauugucuuuuucaugucugauuuuccuaucgccaacggacaggacggccugaaagugcccuguacuauaccacaagaguucguaacccauuuuguuaaugaacaggcaccuacaagaggggaagccgcuuugcuacacuacguggaucccgacacucacaggaaccugggagaguucaagcucuauccagaggguuuuaugaccugcgucccgaauagcucaggcagugggccucagacacugcccauuaacggaguguucaccuuugucuccugggugagccgguucuaccagcuuaaaccaguuggcacuacgggucccgugcgccgacuggggaucagaaggucuuga

SEQ ID NO: 18256 - RNA, 1623 nt, Artificial Sequence
  derived and/or modified sequence opt3 from VP1__Norovirus__AFV08771
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucucugugccuaucuuaacugucgaggaaaugacaaacagccgcuuucccauaccacuggagaaacuuuucaccggacccuccucaacguucgugguucagccucagaaugguagauguacuaccgauggcguguugcuggggacaacucaacuaaguccagucaacauuugcaccuuuaggggagacgugacacauaucgccggcagccggaauuacaccaugaaccucgcaucucagaauuggaacuccuaugauccgacggaggaaauucccgcuccucuggguacuccagacuucguagggaagauccagggaguucuuacacagaccacucgcacagacggcucaacccgaggccacaaggccacgguguacaccgggagcgcugauuuuagucccaagcugggaagaguccaauucgccacagacacugauaaugacuuugaugcaaaccagaauaccaaauucacaccugugggugucauccaggacggcaacacugcccauaggaaugagccacaacaguggguguugcccucuuacuccgggcggaacacccacaauguucaccucgcuccggcgguggcaccuacauuuccaggagaacagcuguuauucuuucguagcaccaugcccggcuguucggguuauccuaacauggaucuggacugccuccuuccccaggaguggguacaauacuucuaucaggaagccgcuccagcccagucugaugucgcacuguugcgcuuugugaacccugacacugggagaguucuauucgaguguaagcugcauaaauccggcuacgugacggucgcccacacaggacagcaugaucucgugauucccccaaauggcuauuuuagguucgacucauggguaaaccaauucuacacccuggcuccgauggggaauggaacuggucggcgacgcgcccuuuga

SEQ ID NO: 18257 - RNA, 1623 nt, Artificial Sequence; identical to SEQ ID NO: 17854
  derived and/or modified sequence opt3 from VP1__Norovirus__AFV08774

SEQ ID NO: 18258 - RNA, 1623 nt, Artificial Sequence
  derived and/or modified sequence opt3 from VP1__Norovirus__AFV08777
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaucguuuccgaucgagggccucucacccagccagguaacgauguucccucauauaaucguugacgugcgccaacuggagccaguccuuauuccccugccugaugugcgaaacaauuuuuaucacuacaaccagaguaaugacccaaccaucaaguugauugcaaugcucuauacaccccugcgugcuaacaaugccggggaugacguguucacugucuccugcagaguucugaccaggccgucuccugauuuugacuucaucuuucucgugcccccaacaguagaaagccggaccaaaccuuucuccgugcccgucuuaacuguggaggaaaugacaaacucacgcuuuccaauaccccuggagaaacuuuucaccggaccuaguagcgcguucguugugcagccacagaacgguagauguacgacugauggcgucuugcuggggaccacacaacuaucuccggugaauauuugcacuuuuaggggaaacguaacccauaucuccggcucacggaauuacacaaugaaccucgccagccagaauuggaacaguuaugaccccaccgaggaaauuccugcaccacuggguacgcccgauuucguugggaagauccagggagugcuuacucagacaaccaagacuaauggcucuacacgcggccacaaggcuaccgucuacacgggguccgccgacuuuagcccuaaacugggacgagugcaauucgcuaccgacacagauaacgacuuugagacuaaucagaacaccaaguucacaccagucggugugauccaggauggcucgacuacccccagaaaugaaccgcaacaguggguuuugccuucuuacuccgggaggaacacacauaaugugcaccucgccccagcaguagcccccaccuuuccuggagagcagcuguuauucuuucggucaacuaugcccggcuguagugguuauccaaacauggaccuggauugccuccuuccucaggaauggguccaauacuucuaucaggaggcugcgcccgcacagagcgacguggcccuguugcguuuuguuaauccagauacggggcgcgugcuauucgaguguaaacugcacaaguccggcuacgucacaguggcucauaccggacagcacgaccucguaauuccgccuaacggcuauuuuagauucgauucuugggugaaccaauucuacacucuggcccccauggggaauggaaccgguaggcggcgagcacuuuga

SEQ ID NO: 18259 - RNA, 1623 nt, Artificial Sequence
  derived and/or modified sequence opt3 from VP1__Norovirus__AFV08780
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgaucaugacuuugaugccaaucagaauacaaaauucacuccagugggugucauccaggacggcgauaccgcucacaggaacgagccccaacaguggguguugccgagcuacagugggcguaauucucacaacguucaucucgcgccuacaguggcaccaaccuuucccggagaacagcuguuauucuuucgguccacuaugccuggcuguagcgguuaucccaauauggaccuggauugccuccuuccacaggaguggguacaauacuucuaucaggaagccgcuccugcccagucggacgucgcacuguugcgcuuugugaaccccgauacggggagaguucuauucgaguguaagcugcacaaaucuggcuacgugacagucgcccauaccggacagcacgaccucgugauuccaccgaauggcuauuuuagguucgacuccuggguaaaccaauucuacacucuggcuccuauggggaacggaaccggucggcgacgcgcccuuuga

SEQ ID NO: 18260 - RNA, 1623 nt, Artificial Sequence
  derived and/or modified sequence opt3 from VP1__Norovirus__AFV08783
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggaaugcuuacacagaccacucgcacagacggcagcacccgaggccacaaggcuacgguguacaccgggagugccgauuuuucuccuaagcugggaagaguccaauucgcuacagacacugauaaugacuuugugaccaaucagaacacaaaauucacuccagucggugugauccaggauggcuccaccacacccaggaaugagccgcaacaguggguuuugccuagcuacucggggcggaacacccauaaugugcaccucgccccagcaguagcccccacuuuuccuggagaacagcuguuauucuuucguucuacgaugcccggcuguuccgguuauccaaacauggaccuggauugccuccuuccucaggaguggguccaauacuucuaucaggaagcugcgcccgcacagucagacguggcccuguugcgcuuuguuaauccagauacagggagagugcuauucgaguguaagcugcacaaaaccggcuacgucacuguggcucauaccggacagcacgaccucguaaucccgccuaacggcuauuuuagguucgauaguugggugaaccaauucuacacacuggcccccauggggaauggaaccggucggcgacgcgcacuuuga

SEQ ID NO: 18261 - RNA, 1623 nt, Artificial Sequence
  derived and/or modified sequence opt3 from VP1__Norovirus__AFV08786
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagucuggcuaugucacaguggcccauaccgggcagcacgaucugguaauuccgccuaacggauacuuucgcuucgacuccugggugaaucaguucuauacucuugcacccauggguaacggcaccgggagaaggcgggcccuguga

SEQ ID NO: 18262 - RNA, 1623 nt, Artificial Sequence
  derived and/or modified sequence opt3 from VP1__Norovirus__AFV08789
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucggcacagacacugaaaacgauuuugagacccaucaaaauacaaaguucacuccagugggggucauccaggacggaggcaccacacaccgaaacgaaccccagcaaugggugcucccgagcuacagugguagagauguuccuaaugugcaccuggcaccagccguagcucccaccuuuccuggggagcaguuacuguucuuuaggucuacuaugcccggcuguuccggauauccaaacauggaccucgauugccuucugccucaggaguggguccagcauuucuaccaagaagcggcacccgcccagagcgacguggcuuugcuacgguuuguuaauccagauacgggccgugugcuguucgaguguaaacuccacaagucgggguaugucacaguggcccauaccggacagcacgaccugguaauuccgccuaacgguuacuuucgcuucgauucuugggugaaccaguucuauacucuugcacccaugggcaaugggaccggaagaaggcgggcccuguga

SEQ ID NO: 18263 - RNA, 1623 nt, Artificial Sequence
  derived and/or modified sequence opt3 from VP1__Norovirus__AFV08792
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaucccacuggagaaacuuuucaccggacccucaagugccuucgucgugcagccucagaacgguagauguacgacugauggcguauugcuggggaccacacaacuaagcccaguuaauauuugcacuuuuaggggagacgugacccauaucacaggcucucggaacuacaccaugaaucucgcaucccagaacuggaauaacuaugauccgacggacgagauacccgcuccucuggguacuccagacuucgucgggaagauucagggaaugcuuacacagaccacucgcacagauggcucaacccgaggccacaaggccacgguguacaccgggagcgcugacuuugcccccaagcugggaagaguccaauucgaaacagauacugaccaugauuuugaggcaaaucagaacaccaaauucacaccuguggguguuauccaggacggcaguacuacccacaggaaugaaccacaacaguggguguugcccucuuacuccgggcggaacacacacaauguacaucucgccccggcugucgcgccuaccuuuccaggagagcagcuguuauucuuucguagcacuaugcccggcuguucggguuauccuaacauggaucuggacugccuccuuccccaggaaugggugcaauacuucuaucaggaggcagccccagcucagucugauguugcccuguugcgcuuugugaauccugacacggggagaguccuauucgaguguaagcugcacaaauccggcuacgugacaguagcacauaccggacagcacgaucucgugauucccccaaacggcuauuuuagguucgacucauggguuaaccaauucuacacucuggccccgauggggaauggaaccggucggcgacgcgucguguga

SEQ ID NO: 18264 - RNA, 1623 nt, Artificial Sequence
  derived and/or modified sequence opt3 from VP1__Norovirus__AFV08795
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaaugauuaugaccccacggaggaaauaccugcuccacuggguacucccgacuucgucgggaagauucagggagugcuuacacagaccacucgcacagauggcuccacccgaggccacaaggccacggucuacaccgggucagcugacuuugccccuaagcugggaagagugcaauucgagacagauacugacagggauuuugaagcaaaccagaauaccaaauucacaccaguuggugugauccaggacggcgggacuacccaucggaacgagccccaacaguggguauugccgagcuacaguggacguaauacacacaacguccaccucgccccugcuguggcgccaaccuuucccggcgaacagcuguuauucuuucgcucuacuaugccugguuguuccggguaucccaauauggaucuggacugccuccuuccacaggaguggguucaauacuucuaucaggaggcagccccugcucagagcgauguggcccuguugagauuugucaaccccgacacgggcagggugcuauucgaauguaagcugcauaaaucgggauacguaacaguggcacacaccggccagcaugaucucguuauuccaccgaauggguauuuucgguucgacucuugggucaaccaauucuacacucuggccccuaugggaaacgguaccggccgacgcagagcuguguga

SEQ ID NO: 18265 - RNA, 1623 nt, Artificial Sequence
  derived and/or modified sequence opt3 from VP1__Norovirus__AFX95940
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaagcaaaccagaauaccaaauucacaccaguuggugugauccaggauggcaguacuacccaucggaacgagccccaacaguggguauugccgucuuacuccgggcguaauacaccuaacguccaccucgccccagcuguggcgcccaccuuuccuggagaacagcuguuauucuuucgcagcacuaugcccggcuguucggguuauccaaauauggaccuggauugccuccuuccucaggaguggguucaauacuucuaucaggaggcagcccccgcucagucugacguggcccuguugagauuugucaacccagauacggggagggugcuauucgaauguaagcugcacaaauccggcuacguaacaguggcacauaccggacagcacgaccucguuauuccgccuaauggcuauuuucgguucgauucaugggucaaccaauucuacacucuggcccccauggggaacggaaccggucgacgcagagcucuuuga

SEQ ID NO: 18266 - RNA, 1620 nt, Artificial Sequence
  derived and/or modified sequence opt3 from VP1__Norovirus__AFZ84663
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugagcaauucccgcuuucccauaccacuggagaaacuuuacacgggacccucaagugcguucgugguucagccucagaacgguagauguacuaccgauggcguguugcuggggacaacucaacuaagcgccgucaauauuugcaccuucaggggagacgugacacauaucgcaggcucucacgauuauaccaugaaccucgcuucccagaauuggaacaauuacgacccaacggaggaaauuccggcuccccuggguacuccugacuuuguagggaagauccagggaaugcuuacacagaccacucgggaggauggcucaacacgcgcccauaaggccaccguuagcacgggcagugugcacuucaccccaaagcuggggucuguccaauacacaacugacaccaacaaugauuuucagacaggacagaacacuaaauucacccccgugggugucauccaagacggcaauaaccaccagaaugaaccucagcaguggguguugccaaacuauuccgggcgaacaggacauaauguucaccucgcacccgccguggcuccgaccuuuccuggcgagcaacuguuauucuuuagaagcacuaugccagguuguucgggguaccccaacaugaaccuggauugccuccuuccucaggaauggguacagcauuucuaucaggaggcggcacccgcccaaucugacgucgcucuguugagguuugugaauccagauacgggccggguucuauucgaguguaagcugcacaaauccggauacgugacagucgcccacaccggcccucaugaccucgugauucccccaaacggguauuuucguuucgauucauggguaaaucaguuuuacacucuggcaccgaugggaaacggugccggccgcagaagggugcuuuga

SEQ ID NO: 18267 - RNA, 1623 nt, Artificial Sequence
  derived and/or modified sequence opt3 from VP1__Norovirus__AGG37871
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggaggcagccccugcucagagcgaaguggcccuguugcgcuuugucaaucccgacacgggcagagugcuauucgaguguaagcugcacaaaucgggauacguaacaguggcacauaccggccaguaugaucucguuauuccaccgaacggguacuuuagguucgacucuugggucaaccaauucuauacucuggccccuaugggaaaugguaccggccggcgacgcgcuguguga

SEQ ID NO: 18268 - RNA, 1623 nt, Artificial Sequence
  derived and/or modified sequence opt3 from VP1__Norovirus__AGI96383
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggaacucauaugaucccacggaggaaauuccugcaccacuggguacucccgacuucguagggaagauccagggaguucuuacacagaccacuagcacaaauggcaguacccggggccauaaggcuacgguguacaccgggucugccgacuuuuccccuaagcugggacgcguccaauucagcacagauacuaauaacgacuuugagaccaaucagaacacaaaauucacuccagugggugucauccaggauggcucgaccacaccccgaaaugaaccgcaacaguggguguugccuucuuacuccgggagaaacauucacaauguucaccucgcuccagccguggcacccaccuuuccuggagagcagcuguuauucuuuaggucaacuaugcccggcuguagugguuauccaaacauggaccuggauugccuccuuccucaggaauggguacaauacuucuaucaggaggccgcucccgcgcagagcgacgucgcacuguugcgguuugugaacccagauacggggcguguucuauucgaguguaagcugcauaaauccggcuacgugacagucgcccacaccggacagcaugaccucgugauaccgccuaauggcuauuuucgcuucgauucuuggguaaaccaauucuacacucuggcucccauggggaauggaaccgguagaaggcgggcccuuuga

SEQ ID NO: 18269 - RNA, 1623 nt, Artificial Sequence
  derived and/or modified sequence opt3 from VP1__Norovirus__AGI99552
augaagauggccagcuccgacgcuaaccccucugauggcucagcagccaaucuggugccuaaagucaacaaugagguuauggcgcucgaaccagugguaggggcugccaucgcagccccgguggcuggacagcaaaacgucauugaccccuggauaaagaauaacuucgugcaggcaccugguggcgaguuuaccguuagucccaaaaaugccccaggggaaauccuuuggagcgcuccucugggaccagauuugaaccccuacuuaucccaccuggccaagauguauaauggcuacgcggguggguucgaggugcaggucauucuagcaggaaacgccuuuacagcuggcaaagugaucuucgccgcaguaccuccaaauuuuccgacugaaggccucucucccucgcagguuacgauguucccucauauuguggucgacgugagacaacuggagccagugcuuaucccccugccugaugucaggaacaauuuuuaucacuacaaccagucaaaugacccaaccauaaaguugaucgcuaugcucuauacaccccugcgggccaacaacgcgggggaugacguuuucacugugagcugccgcguacugacccgaccgaguccugauuuugacuucauuuuucucgugcccccaacagucgagucccguaccaagccuuucucugugcccguuuuaacuguggaagagaugacaaauagcagauuuccaaucccccuggaaaaacuuuucaccggaccuuccucagccuucgucgugcagccacagaacgguagguguacgacugauggcguauugcuggggaccacacaacuaaguccgguuaauauuugcacuuuucggggagacgugacccauacaaucggcagccgcaacuacaccaugaaucucgcaucucagaacuggaauaacuaugaucccacggaggagauaccugcuccacuggguacucccgacuucgucgggaagauucagggagugcuuacacagaccacuagaacagacggcuccaccaggggccacaaagccacggucuacaccgggucagcugauuuugccccuaagcugggacgggugcaauucgaaacagacacugaucaugacuuugaggcaaaucagaacaccaaauucacaccaguuggugugauccaggauggcagcacuacccaccgcaaugaaccccaacaguggguauugccgaguuacucugggcgaaacacacacaauguccaucucgccccugcuguggcgccaaccuuucccggagagcagcuguuauucuuuagauccacuaugccuggcuguagcgguuaucccaacauggaccuggauugccuccuuccacaggaauggguucaauacuucuaucaggaggcagccccugcucagucggacguggcccuguugagguuugucaaucccgauacggggcgggugcuauucgaguguaagcugcacaagucuggcuacguaacaguggcacauaccggacagcacgaccucguuauuccaccgaacggcuauuuucguuucgauuccugggucaaccaauucuacacucuggccccuauggggaauggaaccggucgcagaaggccccuuuga

SEQ ID NO: 18270 - RNA, 1623 nt, Artificial Sequence
  derived and/or modified sequence opt3 from VP1__Norovirus__AGI99553
augaagauggccagcuccgacgcuaaucccccugauggcucugcagccaaccuggugccaaaagucaacaaugagguuauggcgcucgaaccggugguaggggcugccaucgcagcccccguggcuggacagcaaaacgucauugacccuuggauaaagaauaacuucgugcaggcaccagguggcgaguuuaccguuucacccaaaaaugccccuggggaaauccuuuggagugcuccacugggacccgauuugaacccuuacuuaagccaccuggccagaauguauaauggcuacgcggguggguucgaggugcaggucauucuagcaggaaacgccuuuacagcuggcaaggugaucuucgccgcaguaccaccgaauuuucccacugaaggccucuccccuucucagguuacgauguucccacauauuguggucgacgugaggcaacuggagcccgugcuuaucccucugccagauguccggaacaauuuuuaucacuacaaccagucgaaugaccccaccauaaaauugaucgcuaugcucuauacaccgcugcgcgccaacaacgcgggggaugacguuuucacugugucaugccgaguacugacccguccuagccccgauuuugacuucauuuuucucgugccaccuacagucgagaguagaaccaagcccuucuccgugccaguuuuaacuguggaagagaugacaaauucuagguuucccaucccucuggaaaaacuuuucaccggaccaagcuccgccuucgucgugcagccgcagaacggucgguguacgacugauggcguauugcuggggaccacacaacuaucacccguuaauauuugcacuuuucgcggagacgugacccauaucacaggcaguagaaacuacaccaugaaucucgcaagccagaacuggaauaacuaugauccuacggaggagauaccagcuccccuggguacuccugacuucgucgggaagauucagggagugcuuacacagaccacuaggacagacggcucuacccggggccacaaggccacggucuacaccggguccgcugauuuugccccaaaacugggacgcgugcaauucgaaacagacacugaucaugacuuugaggcaaaucagaacaccaaguucacacccguuggugugauccaggauggcucaacuacccaccgaaaugaaccgcaacaguggguauugccuagcuacagugggagagacacacacaacguccaucucgccccagcuguggcgcccaccuuuccuggagagcagcuguuauucuuuaggucuacuaugcccggcuguuccgguuauccaaauauggaucuggacugccuccuuccucaggaauggguucaauacuucuaucaggaggcagcccccgcucagagcgauguggcccuguugcgguuugucaacccagacacggggcgugugcuauucgaguguaaacugcacaagucgggcuacguaacaguggcacauaccggacagcacgaucucguuauuccgccuaauggcuauuuucgcuucgacucuugggucaaccaauucuacacucuggcccccauggggaacggaaccgguagaaggcggccacuuuga

SEQ ID NO: 18271 - RNA, 1623 nt, Artificial Sequence
  derived and/or modified sequence opt3 from VP1__Norovirus__AGI99554
augaagauggccagcuccgacgcuaaccccucugauggcucagcagccaaucuggugccuaaagucaacaaugagguuauggcgcucgaaccagugguaggggcugccaucgcagccccgguggcuggacagcaaaacgucauugaccccuggauaaagaauaacuucgugcaggcaccugguggcgaguuuaccguuaguccaaagaaugcccccggggaaauccuuuggagcgcuccucugggaccagauuugaaccccuacuuaucccaccuggccagaauguauaauggcuacgcggguggguucgaggugcaggucauucuagcaggaaacgccuuuacagcuggcaaggugaucuucgccgcaguaccuccaaauuuuccgacugaaggccucucucccucgcagguuacgauguucccucauauuguggucgacgugaggcaacuggagccagugcuuaucccccugccugauguccggaacaauuuuuaucacuacaaccagucaaaugacccaaccauaaaauugaucgcuaugcucuauacaccccugcgcgccaacaacgcgggggaugacguuuucacugugagcugccgaguacugacccguccgaguccugauuuugacuucauuuuucucgugcccccaacagucgaguccagaaccaagccuuucucugugcccguuuuaacuguggaagagaugacaaauagcagguuuccaaucccccuggaaaaacuuuucaccggaccuuccucagccuucgucgugcagccacagaacggucgguguacgacugauggcguauugcuggggaccacacaacuaaguccgguuaauauuugcacuuuucgcggagacgugacccauaucacaggcagcagaaacuacaccaugaaucucgcaucucagaacugguccaauuaugaucccacggaggagauaccugcuccacuggguacucccgacuucgucgggaaaauucagggagugcuuacacagaccacuaggacagacggcucaacccggggccacaaggccacggucuacaccgggagcgcugauuuugccccuaaacugggacgcgugcaauucgaaacagacacugaucgagacuuugaggcaaaccagaauaccaaguucacaccaguuggugugauccaggauggcaguacuacccauagaaacgaaccccaacaguggguauugccgucuuacuccgggaggaauacaccuaacguccaccucgccccagcuguggcgcccaccuuuccuggagagcagcuguuauucuuucggagcacuaugcccggcuguucggguuauccaaauauggaccuggauugccuccuuccucaggaauggguucaauacuucuaucaggaggcagcccccgcucagucugacguggcccuguugcguuuugucaacccagauacggggcgcgugcuauucgaguguaaacugcacaaguccggcuacguaacaguggcacauaccggacagcacgaccucguuauuccgccuaauggcuauuuuagauucgauucaugggucaaccaauucuacacucuggcccccauggggaacggaaccgguaggcggcgaccacuuuga

SEQ ID NO: 18272 - RNA, 1623 nt, Artificial Sequence
  derived and/or modified sequence opt3 from VP1__Norovirus__AGI99555
augaagauggccagcuccgacgcuaaccccucugauggcucagcagccaaucuggugccuaaagucaacaaugagguuauggcgcucgaaccagugguaggggcugccaucgcagccccgguggcuggacagcaaaacgucauugaccccuggauaaagaauaacuucgugcaggcaccugguggcgaguuuaccguuaguccaaagaaugcccccggggaaauccuuuggagcgcuccucugggaccagauuugaaccccuacuuaucccaccuggccagaauguauaauggcuacgcggguggguucgaggugcaggucauucuagcaggaaacgccuuuacagcuggcaaggugaucuucgccgcaguaccuccaaauuuuccgacugaaggccucucucccucgcagguuacgauguucccucauauuguggucgacgugaggcaacuggagccagugcuuaucccccugccugauguccggaacaauuuuuaucacuacaaccagucaaaugacccaaccauaaaauugaucgcuaugcucuauacaccccugcgcgccaacaacgcgggggaugacguuuucacugugagcugccgaguacugacccguccgaguccugauuuugacuucauuuuucucgugcccccaacagucgaguccagaaccaagccuuucucugugcccguuuuaacuguggaagagaugacaaauagcagguuuccaaucccccuggaaaaacuuuucaccggaccuuccucagccuucgucgugcagccacagaacggucgguguacgacugauggcguauugcuggggaccacacaacuaaguccgguuaauauuugcacuuuucgcggagacgugacccauaucacaggcagcagaaacuacaccaugaaucucgcaucucagaacuggaauaacuaugaucccacggaggagauaccugcuccacuggguacucccgacuucgucgggaaaauucagggagugcuuacacagaccacuaggacagacggcuccacccggggccacaaggccacggucuacaccgggucagcugauuuugccccuaaacugggacgcgugcaauucgaaacagacacugaucaugacuuugaggcaaaucagaacaccaaguucacaccaguuggugugauccaggauggcgggacuacccaccgaaaugaaccccaacaguggguauugccgagcuacaguggaagaaacacacacaauguccaucucgccccugcuguggcgccaaccuuucccggcgagcagcuguuauucuuuaggucuacuaugccugguuguuccggguaucccaacauggaccuggauugccuccuuccacaggaauggguucaauacuucuaucaggaggcagccccugcucagagcgacguggcccuguugcgguuugucaaucccgauacgggccgugugcuauucgaguguaaacugcacaagucgggauacguaacaguggcacauaccggccagcacgaccucguuauuccaccgaacggguauuuucgcuucgauucuugggucaaccaauucuacacucuggccccuaugggaaaugguaccggcagaaggcggccccuuuga

SEQ ID NO: 18273 - RNA, 1623 nt, Artificial Sequence
  derived and/or modified sequence opt3 from VP1__Norovirus__AGK25882
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccgacuggagccaguccuuaucccccugccugaugugcguaacaauuuuuaucacuacaaccaaucaaaugacagcaccauuaaguugaucgcuaugcucuauacaccacugagagccaacaacgcgggggaagauguguucacugucaguugcaggguucugacccggcccuccccggacuuugauuucauuuuucucgugccucccacaguagagucucgcaccaaaccauucacugugccuaucuuaacagucgaagagaugaccuacagcagauuucccauaccacuggagaaacuuuucacgggacccuccucagccuucgugguucagccucagaaugguagguguacuaccgacggcguguugcuggggacaacucagcuaaguccagucaacauuugcaccuuucggggagaugugacacauaucgcaggcagccgcaauuauaccaugaaccucgcuucucugaauuggaacaauuacgacccgacggaagagauucccgccccucuugguacuccagauuucguagggaagauccaaggaaugcugacacagaccacuaagggcgacggcuccacacgagggcacaaggcuaccguuuacacgggaucagcccccuuuaccccuaaauuggguagcgugcaguucgaaacagacacugagaacgauuuugaaacccaucagaauaucaaguucacaccagucggcgugauucaagacgggggaacuacccacagaaacgagccccagcaguggguccucccgaguuauucuggcaggaaugugccuaacguucaccuggcaccagccguggcucccacauuuccuggugagcaauuacuguucuuucgguccaccaugcccggguguagcggcuacccaaauauggaucucgacugccuucugccucaggaauggguacagcauuucuaucaggaggcggcacccgcccaaucggaugucgcuuugcuacguuuugugaacccagacacuggacgcguucuguucgaauguaaacuccacaagucuggcuacgugacggucgcccauacagggcagcacgaucugauaaucccgccuaauggauauuuuagauucgacuccugggugaaccaguucuacacccuugcacccauggguaacggcacugggaggcggcgagcccuguga

SEQ ID NO: 18274 - RNA, 1623 nt, Artificial Sequence
  derived and/or modified sequence opt3 from VP1__Norovirus__AGK25884
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaaugcugacacagaccgcuaagggcgacggcuccacucgcgggcacaaggccacaguuuacaccggaucagcacccuuuacgccuaaauuggguagcgugcaguucgaaaccgacacagagaaugauuuugaaacucaucaaaacaccaaguucacaccagucggcgugauccaggacgggggaacuacccaccgaaaugagccccagcaauggguccucccgaguuacucuggcagaaacgugccuaauguucaccuggccccagcuguggcgcccacauuuccuggugagcaguuacuguucuuuagguccaccaugcccggguguagcggcugcccagauauggaccucgauugucuucugccucaggaauggguacagcauuucuaucaagaggcagcccccgcucagucggacgucgccuugcuacgguuugugaacccagauacuggacguguucuguucgaaugcaaacuccacaagucuggcuacgugacggucgcacauacagggcagcacgaccugauuauaccgccuaauggauauuuucgcuucgauuccugggugaaccaguucuacacccuugcccccauggguaacggcacugggagaaggcgggcucuguga

SEQ ID NO: 18275 - RNA, 1623 nt, Artificial Sequence
  derived and/or modified sequence opt3 from VP1__Norovirus__AGK25887
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacaucacccauauaacaggcagccggaacuacaccaugaaucucgcaucucagaacuggaauaacuaugaucccacggaggaaauuccugcuccacuggguacucccgacuucguggggaagauccagggaguccuuacacagaccacucgcacagacggcuccacccgaggccacaaggccacggugcauaccgggucagcugauuuugccccuaagcugggaagaguccaauucgagacagacacugaucacgacuuugaagcaaaucagaacaccaaauucacaccaguggguguuauucaggauggcgggacuacccacaggaaugagccccaacaguggguguugccgagcuacaguggacggaacacacauaauguacaccucgccccugcugucgcgccaaccuuucccggcgaacagcuguuauucuuucguucuacuaugccugguuguuccggguaccccaacauggaccuggauugccuccuuccacaggagugggugcaauauuucuaccaggaggcagccccugcucagagcgacguugcccuguugcgcuuugugaaucccgauacgggcagaguccuauucgaauguaagcugcauaaaucgggauaugugacaguagcacacaccggccagcacgaccucgugaucccaccgaacggguacuuuagguucgauucuuggguuaaccaauucuauacucuggccccuaugggaaaugguaccggccggcgacgcgcugucuga

SEQ ID NO: 18276 - RNA, 1623 nt, Artificial Sequence
  derived and/or modified sequence opt3 from VP1__Norovirus__AGK25890
augaagauggccagcuccgacgcuaaccccucugauggcucagcagccaaucuggugccugaggucaacaaugaaguuaucgcgcucgagccagugguaggggcugccauugcagccccgguggcuggacagcaaaacgucauagaccccuggaucagaaauaacuucgugcaggcaccugguggcgaauuuaccguuaguccaaggaaugcccccggggagauucuuuggagcgcuccucugggaccagauuugaaccccuacuuaucccaccuggcccggauguauaauggcuacgcggguggguucgaagugcaggucauccuagcaggaaacgccuuuacagcuggcaaagugauuuucgccgcaguaccuccaaauuuuccgacugagggccucucucccucgcagguuacgauguucccucauaucguggucgacgugcgccaacuggagccagugcuuauaccccugccugauguccgaaacaauuuuuaucacuacaaccagucaaaugacccaaccaucaaguugauugcuaugcucuauacaccccugcgugccaacaacgcgggggaugacguuuucacugugagcugcagaguacugaccaggccgaguccugauuuugacuucaucuuucucgugcccccaacagucgaaucccggaccaaaccuuucucugugcccguuuuaacuguggaggaaaugacaaauagccgcuuuccaauuccccuggagaaacuuuucaccggaccuuccucagccuucgucgugcagccacagaacgguagauguacgacugauggcguauugcuggggaccacacaacuaaguccgguuaauaucugcacuuuuaggggagacauagcacauauuaccggcagccggaacuacacaaugaaucucgcuucucagaacuggaauaacuaugaucccaccgaggaaaucccugccccacuggguacgcccgacuucguggggaagauucagggaguccuuacucagacaacccgcacugacggcuccacacgaggccacaaggcuaccguguacacggggucagccgauuuugcaccuaagcugggaagaguccaauucgagaccgacacagaucaugacuuugaagccaaucagaacacuaaauucaccccaguggguguuauccaggauggcgggacaacucacaggaaugagccccaacaguggguguugccgagcuacaguggacggaacacccacaauguacaucucgcuccugcggucgcaccaacauuucccggcgaacagcuguuauucuuucguucuaccaugccugguuguuccggguaucccaacauggaccuggauugccuccuuccacaggagugggugcaauacuucuaucaggaggccgcuccugcccagagcgacguugcacuguugcgcuuugugaaucccgauacuggcagaguccuauucgaauguaaccugcacaagucgggauacgugacgguagcccauacaggccagcacgaccucgugaucccaccgaacggguauuuuagguucgauucuuggguuaaucaauucuacacccuggcuccuaugggaaacgguacuggccggcgacgcgccgucuga

SEQ ID NO: 18277 - RNA, 1623 nt, Artificial Sequence; identical to SEQ ID NO: 17662
  derived and/or modified sequence opt3 from VP1__Norovirus__AGK25892

SEQ ID NO: 18278 - RNA, 1623 nt, Artificial Sequence
  derived and/or modified sequence opt3 from VP1__Norovirus__AGK25898
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggauacaacucaacuaucaccagucaacauuugcaccuuuaggggagacgugacacauaucgcagggagucggaauuacaccaugaaccucgcuagccugaauuggaacaauuaugauccgacggaagagauucccgccccucuuggcacuccagacuucguagguaagauccaggggaugcugacacagaccacuaagggagacggcucuacacgcggccacaaggcuaccguuuacacgggguccgcccccuuuaccccuaaauugggaucagugcaguucgaaacagauacugagaacgacuuugaaacccaucaaaauacaaaguucacuccagucggugugauccaggauggcgggaccacacaccgaaacgagccccagcaauggguccucccgagcuacaguggaagaaaugugccuaacgcacaccuggccccagcuguugcgcccaccuuuccuggcgagcaguuacuguucuuuaggucuacuaugcccgguuguuccggguauccaaauauggaccucgauugccuucugccucaggaaugggugcagcauuucuaccaagaggcagcccccgcucagagcgacguagccuugcuacgguuugucaacccagauacgggccgugugcuguucgaauguaaacuccacaagucgggauauguuacagcagcccauaccggccagcacgaccuggugauuccgccuaacggguacuuucgcuucgauucuugggucaaucaguucuauacucuugcucccaugggaaacgguaccggcagaaggcgggcccuguga

SEQ ID NO: 18279 - RNA, 1623 nt, Artificial Sequence
  derived and/or modified sequence opt3 from VP1__Norovirus__AGK25900
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaacagcgcuucucucaauuggaacaauuaugacccgacggaagagauucccgccccucuggguacuccagauuucguagggaagauccagggaaugcuuacacagaccacuaagggcgacggcuccacacgcgggcacaaggcuaccguuuacacgggaucagcccccuuuaccccuaaacuggguagcgugcaguucgaaacagacacugagaacgauuuugaaacccaucaaaauacaaaguucacuccagucggcgugauccaggacgggggaaccacacaccgaaacgagccccagcaaugggucuugccgaguuacucuggcagaaaugugccuaacguucaccucgcaccagccguggcucccaccuuuccuggugagcagcuguuauucuuuagguccacuaugcccggguguagcggcuauccaaauauggaucuggacugccuccuuccucaggaauggguacagcauuucuaccaagaggcggcacccgcccagucggaugucgcucuguugcgguuugugaacccagacacgggacguguucuauucgaauguaaacugcacaagucuggcuaugugacagucgcccauaccgggcagcacgaucucgugauuccgccuaacggauacuuucgcuucgacuccuggguaaaucaguucuauacucuggcacccauggguaacggcaccgggagaaggcgggcccuuuga

SEQ ID NO: 18280 - RNA, 1623 nt, Artificial Sequence
  derived and/or modified sequence opt3 from VP1__Norovirus__AGK25902
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugccagcugcagaguccugaccaggcccaguccggacuuugauuucauuuuucucguuccucccacaguggagucccggaccaaaccauucacuguaccuaucuuaacaguggaagagaugaccaacucucgcuuucccauaccacuggagaaacuuuucacgggacccagcuccgcauucgucgugcagccucagaaugguagauguacuaccgacggcguuuugcuggggacaacucaacuaucaccagugaacauuugcaccuuuaggggagaugucacacauaucgcuggcagucggaauuacaccaugaaccucgccagccugaauuggaacaauuaugacccgacggaagagauucccgcuccucuugguacuccagauuucguggggaagauccagggaaugcugacacagaccacuaagggcgacggcucuacacgcgggcacaaggccaccguauacacgggauccgcacccuuuaccccuaaauuggguucaguucaguucgaaacagacacugagaacgauuuugaaacccaucaaaauacaaaguucacuccagugggcgucauccaggacgggggaaccgcccaccgaaacgagccccagcaaugggugcucccgagcuacaguggcagaaaugucccuaacgugcaccuggcuccagcgguugcacccacauuuccuggugagcaguuacuguucuuuaggucuaccaugcccggguguuccggcuauccaaauauggaucucgacugccuucugccucaggaaugggugcagcauuucuaccaagaggccgcucccgcccagagcgauguagcauugcuacgguuugucaacccagacacuggacgugugcuguucgaauguaaacuccacaagucgggcuauguuacgguggcccauacagggcagcacgaucuggucauuccgccuaacggauacuuucgcuucgacucuugggugaaucaguucuauacccuugcucccauggguaacggcacugggagaaggcgggcccuguga

SEQ ID NO: 18281 - RNA, 1623 nt, Artificial Sequence
  derived and/or modified sequence opt3 from VP1__Norovirus__AGK25905
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgcacaggccccugguggcgaauuuaccgugucaccaaggaacgcucccggggagauccuuuggagugccccucugggaccagauuugaaucccuacuuaagccaccuggcgcggauguauaacggcuacgccgguggguucgaaguucaggugauucuagcagagaaugcuuuuacagccggaaaaaucauuuucgcagcugucccuccaaacuuuccgacugagggccucucccccucucgcgugacgauguucccucauaucauaguagacguucgacagcuggaaccagugcuuaucccccugccugauguccguaauaacuuuuaucacuacaaucaaucgaacgacucaaccauuaaguugaucgccaugcucuauacaccacugagagcgaacaaugccggcgaggauguguucacugugagcugcaggguccugacccggcccaguccggacuuugauuucauuuuucucguuccucccacaguggaaucccgcaccaaaccauucacuguaccuaucuuaacaguggaggagaccacgaacucuagauuucccauaccacuggaaaaacuuuucacugggcccagcuccgcauucgucgugcagccucagaauggaagguguaccacagacgguguuuugcugggcacuacccagcuaucaccagugaacauuugcacauuucgcggggaugucacccauaucgcuggaagucggaauuacacgaugaaccucgccagccugaauuggaacaauuaugugccgacugaggaaauucccgcuccucuuggcacaccagacuucguagguaagguucaagggaugcugacccagacuacaaagggagauggcucuacccgaggccacaaggccacgguguacaccggguccgcacccuuuacaccuaaauugggaucaguccaguucgagacugacaccgaaaacgacuuugagacacaucagaauacuaaguucaccccagugggugucauccaagauggcgggacaacccacagaaacgagccccagcagugggugcucccgagcuacaguggaaggaauguuccuaacgugcaccuggccccagcuguagcgcccacuuuuccuggcgaacaauuacuguucuuucggucuacgaugcccgguuguuccggguauccaaauauggaccucgauugccuucugccucaggaguggguccagcauuucuaccaggaagcagcccccgcucaaagcgacguggccuugcuacguuuuguuaacccagauacaggccgcgugcuguucgaguguaaacuccacaagucgggauaugucaccguggcacauacuggccagcacgaccugguaaucccgccuaacggguacuuuagauucgauucuugggugaaucaguucuauacccuugcccccaugggaaacgguacaggcaggcggcgagcucuguga

SEQ ID NO: 18282 - RNA, 1623 nt, Artificial Sequence
  derived and/or modified sequence opt3 from VP1__Norovirus__AGK25908
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccacugugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcuccgcguucgugguucagccucagaaugguagauguaccacagacggcguguugcuggggacuacccaacuaucaccagucaacauuugcacauuuaggggagaugugacccauaucgccggcagucggaauuacacgaugaaccucgcaagccugaauuggaacaauuaugacccgacugaagagauucccgcuccucuugguacaccagauuucguagggaagauccagggaguucugacccagacuacaaagggcgacggcucuacccgcgggcacaaggccacgguguacaccggauccgcucccuuuacaccuaaauuggguucaguccaguucgaaacugacaccgagaacgauuuugaaacacaucaaaauacuaaguucaccccagugggcgucauccaggacgggggaacaacccaccgaaacgagccccagcaaugggugcucccgagcuacaguggcagaaauguuccuaacgugcaccuggccccagcaguagcccccacuuuuccuggugagcaguuacuguucuuuaggucuacgaugcccggguguuccggcuauccaaauauggaucucgacugccuucugccucaggaauggguccagcauuucuaccaagaggcugcgcccgcacagagcgauguggccuugcuacgguuuguuaacccagacacaggacgugugcuguucgaauguaaacuccacaagucgggcuaugucaccguggcucauacugggcagcacgaucugguaauuccgccuaacggauacuuucgcuucgacucuugggugaaucaguucuauacccuugcccccauggguaacggcacagggagaaggcgggcacuguga

SEQ ID NO: 18283 - RNA, 1623 nt, Artificial Sequence
  derived and/or modified sequence opt3 from VP1__Norovirus__AGK25910
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuucuaauuuuccaacugagggccucucgccgucacagguuacgauguucccccauauuaucguggacguccgccaacuggagccugugcuuauaccacugcccgaugugcgaaacaauuuuuaucacuacaaccagagcaaugacaguaccaucaaguugauugcuaugcucuauacacugcugcgugccaacaacgcgggggaugacgucuucacuguuuccugcagagugcucaccaggccuucuccagauuuugacuucaucuuuuuaguacccccgacaguggaaagccggaccaaaccuuucuccguccccgugcugacuguugaggaaaugacaaauucacgcuuuccaauuccucuugagaaguuguucaccggacccaguagcgccuucgugguccagccacagaacgguagauguacgacugauggcgugcugcuagggaccacacaacucucucccguaaauaucugcacuuuuaggggagacguuacccauauaacaggcucccggaacuacaccaugaaucuggcaucacagaacuggaauaacuaugauccuacggaggaaauuccagcuccgcuugguacucccgacuucguggggaaaauccagggaaugcugacacagaccacucgcacagacggcagcacccgaggccacaaggccacgauguacaccgggagugcugauuuugccccuaaguugggaagaguccaauucgagacagacacugaucaugacuuugaagcaaaucagaacaccaaauucacaccagugggugucauucaggauggcgggacuacccacaggaaugagccccaacagugggugcucccuucuuacuccggacggaacacacacaauguucaucuggccccagcuguggcgcccaccuuuccgggcgaacaguuacuguucuuucguccuacuaugccagguuguagcggguaucccaacauggaccucgaucgccuucugccucaggaguggguacaauacuucuaucaggaggcagcccccgcucagucggacgucgccuugcuaagauuugugaauccagauacgggcaggguucuguucgaaugcaagcuccacaaaucuggauacgugacagucgcacauaccggccagcacgaccuggugaucccucccaacggguauuuucgguucgauuccuggguaaaccaauucuacacucuugccccaaugggaaaugguaccggccgacgcagagugguuuga

SEQ ID NO: 18284 - RNA, 1623 nt, Artificial Sequence
  derived and/or modified sequence opt3 from VP1__Norovirus__AGK25912
augaagauggccagcaacgacgcuaaucccuccgauggcucugcagccaaccuggugccugaggucgacaaugaaguuauggcgcucgagccagugguaggggcugccaucgcagccccgguggcuggacagcaaaacgucauugaucccuggauaagaaauaacuucgugcaggcaccugguggcgaauuuaccguuucaccaaggaaugcccccggggagauccuuuggagugcuccucugggaccagacuugaaccccuacuuaagccaccuggcccggauguauaauggcuacgcggguggguucgaagugcaggucauucuagcaggaaacgccuuuacagcuggcaaaaucauuuucgccgcagugccuccaaauuuuccgacugagggccucucccccucucagguaacgauguucccucauaucauaguugaugugcgccaacuggagccaguccuuaucccccugccugacgugcgaaacaauuuuuaucacuacaaccagucgaaugauucaaccauuaaguugaucgcuaugcucuauacaccacugcgugccaacaacgcgggggaagacguguucacugucagcugcagaguucugaccaggcccaguccggauuuugacuucauuuuucucgccccucccacaguggagucccggaccaaaccauucacuguaccuaucuuaacaguggaagagaugaccaauucucgcuuucccauaccacuggagaaacuuuucacgggacccagcuccgcauucgucgugcagccucagaacgguagauguacuaccgauggcguuuugcuggggacaacucaacuaucaccagugaauauuugcaccuuuaggggagacgucacacauaucgcuggcagucggaacuacaccaugaaucucgccagccugaacuggaauaacuaugauccgacggaagagauucccgcuccucuugguacuccagacuucguggggaagauccagggaaugcugacacagaccacuaagggcgacggcucuacacgcgggcacaaggccaccguauacacgggauccgcacccuuuaccccuaaauuggguucaguucaguucgaaacagauacugagaaugacuuugaaacccaucaaaacacaaaguucacuccagugggcgucauccaggaugggggaaccacacaccgaaaugagccccagcaaugggugcucccgagcuacaguggcagaaacgucccuaaugugcaccuggccccagcuguugcgcccaccuuuccuggugagcaguuacuguucuuuaggucuacuaugcccggguguuccggcuauccaaacauggaccucgauugccuucugccucaggaaugggugcagcauuucuaccaagaggcagcccccgcucagagcgacguagccuugcuacgguuugucaauccagauacgggacgugugcuguucgaauguaaacuccacaagucgggcuauguuacaguggcacauaccgggcagcacgaccuggucauuccgccuaacggauacuuucgcuucgauucuugggugaaccaguucuauacucuugcccccauggguaauggcaccgggagaaggcgggcucuguga

SEQ ID NO: 18285 - RNA, 1623 nt, Artificial Sequence
  derived and/or modified sequence opt3 from VP1__Norovirus__AGK25915
augaagauggccagcaacgacgcuaaucccuccgauggcucugcagugaaccuggucccugagguuaauaacgaagugauggcccucgagccaguagugggggcggcuaucgccgcaccggucgccggacagcaaaaugugauugaccccuggauaagaaacaauuucguucaggcuccugguggcgaauuuaccgugucaccaaggaacgcacccggggagauccuuuggagugccccucugggaccagauuugaaucccuacuuaagccaccuggcucggauguauaacggcuacgccgguggguucgaaguccaggugauucuagcgggaaaugcauuuacagccggcaaaaucauuuucgcugccguaccuccaaacuuuccgacugagggccucucccccucucagguuacgauguucccucauaucauaguggacgcacgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcuccgccuucgugguucagccucagaaugguagauguacuaccgacggcguguugcuggggacaacucaacuaucaccagucaacauuugcaccuuuaggggagauguggcacauaucgcuggcagucggaauuacacaaugaaccucgccagccugaauuggaacaauuaugacccgaccgaagagauucccgcuccucuugguacgccagauuucguagggaaaauccagggaaugcugacucagacaaccaagggcgacggcucuacucgcgggcacaaggccacaguuuacaccggauccgcacccuuuacgccuaaauuggguucagugcaguucgaaaccgacacagagaacgauuuugaaacucaucaaaauaccaaguucacaccagucggcgugauccaggacgggggaacuacccaccgaaacgagccccagcaauggguccucccgagcuacaguggcagaaaugugccuaacguucaccuggccccagcuguggcgcccacauuuccuggugagcaguuacuucucuucaggucuaccaugcccggguguuccggcuauccaaauauggaucuugacugccuguugccucaggaauggguacagcauuuuuaccaagaggcagcccccgcucagagcgaugucgcccuacugcgguucgugaacccagacacuggacguguucucuuugaauguaaacugcacaagucgggcuaugugacggucgcacauacagggcagcacgaucuugugauuccgccuucuggauacuuccgcuuugacuccuggguaaaccaguucuauacccuggcccccauggguaauggcacugggagaaggcgggcuuuguga

SEQ ID NO: 18286 - RNA, 1623 nt, Artificial Sequence
  derived and/or modified sequence opt3 from VP1__Norovirus__AGK25917
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucuggauuucccauaccacuggagaaacuuuucacgggucccagcuccgccuucgugguucagccucagaauggccgcuguacuaccgacgggguguugcugggaacaacucaacuaucaccagucaacauuugcaccuuuagaggcgaugugacacauaucgcagguaguaggaauuacaccaugaaccucgcuagccugaauuggaacaauuaugacccgacggaagagauucccgccccucuugggacuccagauuucguaggaaagguucagggcgugcugacacagaccacuaagggcgacgggucuacacggggacacaaggcuaccgucuacacggguuccgcccccuuuaccccuaaauugggcucagugcaguucgaaacagacacugagaacgauuuugaaacccaucaaaauacaaaguucacuccagucggggugauccaggacggaggcaccgcacaccgcaacgagccccagcaauggguucucccgagcuacaguggucgaaaugugccuaacguacaccuggccccagcugucgcgcccacauuuccuggggagcaguuacuguucuuuagaucuaccaugcccggcuguuccggauauccaaauauggaucucgacugccuucugccucaggaaugggugcagcauuucuaccaagaggcagcccccgcucagagcgauguugccuugcuaagguuugugaacccagacacuggccggguccuguucgaauguaaacuccacaagucgggguaugugacgguagcacauacaggacagcgugaucuggugaucccgccuaacgguuacuuucgcuucgacucuuggguuaaucaguucuauacccuugcccccaugggcaacgggacuggaagaaggcgggcucuguga

SEQ ID NO: 18287 - RNA, 1623 nt, Artificial Sequence
  derived and/or modified sequence opt3 from VP1__Norovirus__AGK25919
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaacuccugcuccacuggguacacccgacuucgucgggaagauacagggagugcuuacccagacuacacgcaccgacggcuccacgcgaggccacaaggccaccgucuacacagggucagcugauuuugccccuaagcugggaagagugcaauucgagacugacaccgaucaugacuuugaagcaaaucagaacacaaaauucacuccaguuggugugauucaggauggcgggaccacacacaggaaugagccccaacaguggguauugccgagcuacaguggacggaacacccacaauguccaucucgccccugcuguggcgccaacuuuucccggcgaacagcuguuauucuuucguucuacgaugccugguuguuccggguaucccaacauggaccuggauugccuccuuccacaggaguggguucaauacuucuaucaggaggcagccccugcucacagcgacguggcccuguugcgcuuugucaaucccgauacaggcagagugcuauucgaauguaagcugcauaaaucgggauacguaaccguggcacacacuggccagcacgaccucguuaucccaccgaacggguauuuuagguucgauucuugggucaaccaguucuacacccuggccccuaugggauccgguacaggccggcgacgcgcuguguga

SEQ ID NO: 18288 - RNA, 1623 nt, Artificial Sequence
  derived and/or modified sequence opt3 from VP1__Norovirus__AGK25921
augaagauggccagcuccgacgcuaaccccucugauggcucagcagccaaucuggugccugaggucaacaaugaaguuauggcgcucgagccaguggcuggggccgcaaucgccgcuccgguagcaggacagcaaaacgugauugaccccuggauaagaaauaacuucguccaggccccugguggcgaauuuaccgugaguccaaggaaugcucccggggagauccuuuggagcgccccucugggaccagauuugaaccccuacuuaucccaccuggcgcggauguauaauggcuacgccgguggguucgaaguucaggugauucuagcaggaaacgcuuuuacagccggcaaagucaucuucgcagcugugccuccaaauuuuccgacugagggccucucucccucgcagguaacgauguucccucauauuguuguggacguccgccaacuggagccagugcuuaucccccugccugaugugcgaaacaauuuuuaucacuacaaccagucaaaugacccaaccauaaaguugaucgccaugcucuaugcgccccugcgugccaacaacgcaggggaugacgucuucacaguuagcugcagagugcugacuaggccgaguccugauuuugacuucauuuuucucguacccccaaccguggaaucccggacaaaaccuuucucuguccccguguuaaccguugaggaaaugacuaauagccgcuuuccaaucccccuggagaaacuuuucacaggaccuuccucagcuuucgugguccagccacagaacgguagauguaccacggauggcguguugcuggggacuacccaacuaaguccgguaaauauuugcacauuuaggggagacguuacucauaucaccggcagccggaacuacacaaugaaucucgccucucagaacuggaauaacuaugaucccaccgaggaaauaccugcuccacuggguacgcccgacuucguggggaagauucagggaguccuuacucagacaacccgcacugacggcuccacacgaggccacaaggccaccguguacacggggucagcagauuuugccccuaagcugggaagaguccaauucgagaccgacacagaucaugacuuugaagcuaaucagaacacuaaauucaccccaguggguguuauccaggauggcgggacaacucacaggaaugagccccaacaguggguguugccgagcuacaguggacggaacacccacaauguacaucucgcgccugcagucgccccaacauuucccggcgaacagcuguuauucuuucguucuaccaugccugguuguuccggguaucccaacauggaccuggauugccuccuuccacaggagugggugcaauacuucuaucaggaggcugccccugcacagagcgacguugcccuguugcgcuuugugaaucccgauacuggcagaguccuauucgaauguaagcugcacaaaucgggauacgugacgguagcucauacaggccagcacgaccucgugauuccaccgaacggguauuuuagguucgauucuuggguuaaccaauucuacacccuggccccuaugggaaaugguacuggccggcgacgcgcagucuga

SEQ ID NO: 18289 - RNA, 1623 nt, Artificial Sequence
  derived and/or modified sequence opt3 from VP1__Norovirus__AGK25924
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuccaccggaccuucaagugccuucgucgugcagccacagaacgguagauguacgacugauggcguauugcuggggaccacacaacuaagcccgguuaauauuugcacuuucaggggagacgugacccauaucacaggcucucggaacuacaccaugaaucucgcaucccagaacuggaauaacuaugaucccacggaggaaauaccugcuccacuggguacucccgacuuugucgggaagauucagggagugcuuacacagaccacucgcacagacggcucaacccgaggccacaaggccacggucuacaccgggagcgcugauuucgccccuaagcugggaagagugcaauuugagacagacacugaucaugacuucgaagcaaaucagaacaccaaauuuacaccaguuggugugauccaggauggcgggacuacccacaggaaugagccccaacaguggguauugccgaguuacucuggacggaacacacacaauguccaucucgccccugcuguggcgccaaccuuccccggcgaacagcuguuauuuuuccguuccacuaugccugguuguagcggguaucccaacauggaccuggauugccuccuuccacaggaguggguucaauacuuuuaucaggaggcagccccugcucagucggacguggcccuguugcgcuucgucaaucccgauacgggcagagugcuauuugaauguaagcugcacaaaucuggauacguaacaguggcacauaccggccagcacgaccucguuauuccaccgaacggguauuucagguuugauuccugggucaaccaauucuacacucuggccccuaugggaaaugguaccggccggcgacgcgcuguguga

SEQ ID NO: 18290 - RNA, 1623 nt, Artificial Sequence
  derived and/or modified sequence opt3 from VP1__Norovirus__AGK25927
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuaugcgccccugcgugccaacaacgccggggaugacguuuucacagugagcugcagaguacugacuaggccgaguccugauuuugacuucauuuuucucgugcccccaaccgucgaaucccggacaaaaccuuucucugugcccguuuuaaccguggaggaaaugacuaauagccgcuuuccaaucccccuggagaaacuuuucacaggaccuuccucagcauucgucgugcagccacagaacgguagauguaccacggauggcguauugcuggggacuacccaacuaaguccgguuaauauuugcacauuuaggggagacgugacucauaucaccggcagccggaacuacacaaugaaucucgcuucucagaacuggaauaacuaugaucccaccgaggaaauaccugccccacuggguacgcccgacuucgucgggaagauucagggagugcuuacucagacaacccgcacugacggcuccacacgaggccacaaggcuaccgucuacacggggucagccgauuuugcaccuaagcugggaagagugcaauucgagaccgacacagaucaugacuuugaagccaaucagaacacuaaauucaccccaguuggugugauccaggauggcgggacaacucacaggaaugagccccaacaguggguauugccgagcuacaguggacggaacacccacaauguccaucucgcuccugcgguggcaccaacauuucccggcgaacagcuguuauucuuucguucuaccaugccugguuguuccggguaucccaacauggaccuggauugccuccuuccacaggaguggguucaauacuucuaucaggaggccgcuccugcccagagcgacguggcacuguugcgcuuugucaaucccaacacuggcagagugcuauucgaauguaagcugcacaaaucgggauacguaacgguggcccauacaggccagcacgaucucguuauuccaccgaacgacuauuuuagguucgauucuugggucaaucaauucuacacccuggcuccuauggggaacggaacuggucggcgacgcgccguguga

SEQ ID NO: 18291 - RNA, 1623 nt, Artificial Sequence
  derived and/or modified sequence opt3 from VP1__Norovirus__AGK25930
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugaugucgggaacaauuuuuaucacuacaaccagucaaaugacccaaccauaaaguugaucgcuaugcucuauacaccccugcgagccaacaacgcgggagaugacguuuucacugugagcugccguguacugaccagaccgaguccugauuuugacuucauuuuucucgugcccccaacagucgaauccaggaccaaaccuuucucugugcccguuuuaacuguggaggaaaugacaaauagccgguuuccaaucccccuggagaaacuuuucaccgguccuuccucagccuucgucgugcagccacagaacggccgcuguacgacugaugggguauugcugggaaccacacaacuaaguccgguuaauauuugcacuuuuagaggcgacgugacccauaucacagguagcaggaacuacaccaugaaucucgcaucucagaacuggaauaacuaugaucccacggaggaaauaccugcuccacuggggacucccgacuucgucggaaagauucagggcgugcuuacacagaccacucggacagacggcuccacccgcgggcacaaggccacggucuacaccggaucagcugauuuugccccuaagcugggucgagugcaauucgagacagacacugaucaugacuuugaagcaaaucagaacaccaaauucacaccaguuggcgugauccaggaugggggaacuacccacagaaaugagccccaacaguggguauugccgagcuacaguggcaggaacacacacaauguccaucucgccccugcuguggcgccaaccuuucccggugaacagcuguuauucuuucggucuacuaugccuggguguuccggcuaucccaacauggaccuggauugccuccuuccacaggaguggguucaauacuucuaucaggaggcagccccugcucagagcgacguggcccuguugcguuuugucaaucccgauacgggacgcgugcuauucgaauguaagcugcacaaaucgggcuacguaacaguggcacauaccgggcagcacgaccucguuauuccaccgaacggauauuuuagauucgauucuugggucaaccaauucuacacucuggccccuauggguaauggcaccgggaggcggcgagcuguguga

SEQ ID NO: 18292 - RNA, 1623 nt, Artificial Sequence
  derived and/or modified sequence opt3 from VP1__Norovirus__AGS08025
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacuaagacaaauggcucaacccgcggccacaaggcuacggucuacaccgggagcgccgacuuuaguccaaaacugggacgagugcaauucgcuacagauacugacaaugauuuugagaccaaccagaauacaaaguucacucccgucggugugauccaggacggcucuaccacaccgagaaacgaaccucaacaguggguuuugccauccuacagcgggaggaauauccauaacgugcaccucgcccccgcaguagccccuaccuuucccggagagcagcuguuauucuuucggucgacuaugccaggcuguucugguuauccuaauauggaucuggacugccuccuuccccaggaauggguccaauacuucuaucaggaggcugcgccagcacaguccgauguggcccuguugcguuuuguuaacccggacacggggcgcgugcuauucgaguguaaacugcacaagucaggcuacgucacaguggcucauaccggacagcacgaucucguaauuccucccaacggcuauuuuagauucgacaguugggugaaucaauucuacacucuggccccaauggggaacggaaccgguaggcggcgagcacuuuga

SEQ ID NO: 18293 - RNA, 1623 nt, Artificial Sequence; identical to SEQ ID NO: 17854
  derived and/or modified sequence opt3 from VP1__Norovirus__AGS08026

SEQ ID NO: 18294 - RNA, 1623 nt, Artificial Sequence
  derived and/or modified sequence opt3 from VP1__Norovirus__AGS08027
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggaacucauaugaucccacggaggaaauuccugcaccacuggguacucccgacuucguagggaagauccagggaguucuuacacagaccacuagcgcuaauggcaguacacggggccauaaggccaccguguacacggggucugcugacuuuuccccuaagcugggacgcguccaauucgccaccgauacaaauaacgacuuugagacuaaucagaacaccaaauucacaccagugggugucauccaggauggcaauacuacaccccgaaacgaaccgcaacaguggguguugccuagcuacucggggagaaauauucacaacguucaccucgcaccagccguggcucccaccuuuccuggagagcagcuguuauucuuuaggucuaccaugcccggcuguuccgguuauccaaacauggaccuggauugccuccuuccucaggaauggguacaauacuucuaucaggaggcggcacccgcccagucagacgucgcucuguugcgguuugugaauccagauacugggcguguucuauucgaguguaagcugcauaaaaguggcuacgugacggucgcccacacaggacagcaugaccucgugauaccgccuaacggcuauuuucgcuucgauagcuggguaaaucaauucuacacccuggcacccauggggaacggaacugguagaaggcgggcccuuuga

SEQ ID NO: 18295 - RNA, 1623 nt, Artificial Sequence
  derived and/or modified sequence opt3 from VP1__Norovirus__AGS08028
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggagacggccccugcacagagcgacguggcucuguugcgcuuugucaaucccgauacaggcagagugcuauucgaauguaagcugcacaaaucgugcuacguaaccguggcccauacuggacagcacgaccucguuauuccaccgaacggcuauuuuagguucgauucuugggucaaccaauucuacacccuggcaccuauggggaauggaacaggucggcgacgcgccguguga

SEQ ID NO: 18296 - RNA, 1623 nt, Artificial Sequence; identical to SEQ ID NO: 17702
  derived and/or modified sequence opt3 from VP1__Norovirus__AGS08029

SEQ ID NO: 18297 - RNA, 1623 nt, Artificial Sequence; identical to SEQ ID NO: 17702
  derived and/or modified sequence opt3 from VP1__Norovirus__AGS08030

SEQ ID NO: 18298 - RNA, 1623 nt, Artificial Sequence; identical to SEQ ID NO: 17702
  derived and/or modified sequence opt3 from VP1__Norovirus__AGS08031

SEQ ID NO: 18299 - RNA, 1623 nt, Artificial Sequence; identical to SEQ ID NO: 17662
  derived and/or modified sequence opt3 from VP1__Norovirus__AGS08032

SEQ ID NO: 18300 - RNA, 1623 nt, Artificial Sequence
  derived and/or modified sequence opt3 from VP1__Norovirus__AGS08033
augaagauggccagcuccgacgcuaaccccucugauggcucaguggcaaaucuggucccugagguuaacaaugaagugauggcccucgagccaguagugggggcggcuaucgccgcaccggucgccggacagcaaaacgugauugaccccuggauaagaaauaacuucguucaggcuccugguggcgaauuuaccgugaguccaaggaaugcacccggggagauccuuuggagcgccccucugggaccagauuugaaccccuacuuaucccaccuggcucggauguauaauggcuacgccgguggguucgaaguccaggugauucuagcgggaaacgcauuuacagccggcaaaguaaucuucgcugccguuccuccaaauuuuccgacugagggccucucucccucacaggugacgauguucccucauauugucguggacgugcgccaacuggagccaguccuuaucccccugccugauguucgaaacaauuuuuaucacuacaaccagucgaaugacccaaccauaaaguugaucgcaaugcucuauacaccccugcgugcuaacaacgccggggaugacguguucacuguaagcugcagagugcugaccaggccgaguccugauuuugacuucauuuuucucgucccuccaacaguggaaucccggaccaaaccuuucucuguucccguguuaacugucgaggaaaugacaaauagccgcuuuccaaucccccuggagaaacuuuucaccggaccuuccucagcguucgugguacagccacagaacgguagauguacgacugauggcguuuugcuggggaccacacaacuaaguccggugaauauuugcacuuuuaggggagacgucacccauaucacaggcagccggaacuacaccaugaaucucgccucucagaacuggaauaacuaugaucccacggaggaaauaccugcaccacuggguacucccgacuucguggggaagauucagggaguccuuacacagaccacucgcacagacggcuccacccgaggccacaaggcuacgguguacaccgggucagccgauuuugcuccuaagcugggaagaguucaauucgagacagacacugaucaugacuuugaagccaaucagaacaccaaauucacaccaguggguguaauccaggauggcgggacuacccacaggaaugagccccaacagugggucuugccgagcuacaguggacggaacacacacaaugugcaucucgcacccgccguugcuccaaccuuucccggcgaacagcuguuauucuuucguucuacuaugccugguuguuccggguaucccaacauggaccuggauugccuccuuccacaggagugggugcaauacuucuaucaggaggcggccccugcacagagcgacgucgcucuguugcgcuuugugaaucccgauacgggcagaguacuauucgaauguaagcugcacaaaucgggauacgugacaguugcccauaccggccagcacgaccucgucauuccaccgaacggguauuuuagguucgauucuugggugaaccaauucuacacucuggcaccuaugggaaaugguaccggccggcgacgcgccguguga

SEQ ID NO: 18301 - RNA, 1623 nt, Artificial Sequence
  derived and/or modified sequence opt3 from VP1__Norovirus__AGS08035
augaagauggccagcuccgacgcuaaccccucugauggcucaaccgcaagucuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuagcccaaggaacgcacccggggagauccuuugguccgccccucugggaccagauuugaaucccuacuuaucucaccuggcucggauguauaacucguacgccggcgguuucgaagugcaggucauucuagcggggaaugcauuuacugccggaaaaaucauuuucgcugccgugccuccaaacuuuccgacggagggccucucacccagccagguaaccauguucccucauaucauaguugacgugcgccaacuggagccaguccuuaucccccugccugaugugcgaaauaacuuuuaucacuacaaucagaguaacgacccaacaauuaaguugaucgcaaugcucuauacuccccugcgugcuaauaacgccggcgaugacguguucaccgucuccugcagaguucugacaaggccgucuccugauuuugacuucauuuuucucgugcccccaaccguagaaagccggacuaaaccuuucuccgugcccgucuuaacaguggaggaaaugaccaacucacgcuuuccaaucccccuggagaaacuuuucacggggccuaguagcgcguucguugugcagccacagaauggaagauguacuaccgauggugucuugcugggcacaacucaacuaucuccggugaacauaugcaccuuuaggggagacguaacacauauuuccgggucacacaauuacaccaugaaccucgccagccagaauuggaacaguuaugaucccacggaggaaaucccugcaccacugggcacucccgacuucguugguaagauucagggggugcuuacacagaccacucggaucaauggaucuacacgcggccauaaggcuaccgucuacacgggcuccgccgacuuuagcccuaagcuggggcgagugcaauucgcuaccgauacagacaacgauuuugagacuaaucagaacaccaaauucacaccagucggagugauccaggacgguucgacuacccccagaaaugaaccgcaacaguggguuuugccuucuuacuccggcaggaacacacacaaugugcaccucgccccagcaguagcccccaccuuuccuggggagcagcuguuauucuuucggucaacuaugcccggauguaguggcuauccaaacauggaucuggacugccuccuuccucaggaauggguccaauacuucuaucaggaggcugcgcccgcacagagcgauguggcccuguugcguuuuguuaauccagacacgggucgcgugcuauucgaguguaagcugcauaaauccggguacgucacaguggcucacaccggccagcaugaucucguaauuccgccuaacggauauuuuagauucgacucuugggugaaccaauucuacacucuggcccccaugggcaaugggaccggaaggcggcgagcacuuuga

SEQ ID NO: 18302 - RNA, 1623 nt, Artificial Sequence; identical to SEQ ID NO: 17854
  derived and/or modified sequence opt3 from VP1__Norovirus__AGS08036

SEQ ID NO: 18303 - RNA, 1623 nt, Artificial Sequence; identical to SEQ ID NO: 17702
  derived and/or modified sequence opt3 from VP1__Norovirus__AGS08037

SEQ ID NO: 18304 - RNA, 1623 nt, Artificial Sequence
  derived and/or modified sequence opt3 from VP1__Norovirus__AGS08038
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaugcaaaucagaacaccaaauucacaccaguuggugugauccaggacggcgggacuacccacaggaaugaaccccaacaguggguauugccgagcuacaguggacggaacacacacaauguccaucucgccccugcuguggcgccaaccuuucccggcgagcagcuguuauucuuucguucuacuaugccugguuguuccggguaucccaacauggaucuggacugccuccuuccacaggaauggguucaauacuucuaucaggaggcagccccugcucagagcgauguggcccuguugcgcuuugucaaucccgacacgggcagagugcuauucgaguguaagcugcacaaaucgggauacguaacaguggcacauaccggccagcacgaucucguuauuccaccgaacggguauuuuagguucgacucuugggucaaccaauucuacacucuggccccuaugggaaaugguaccggccggcgacgcgcuguguga

SEQ ID NO: 18305 - RNA, 1623 nt, Artificial Sequence; identical to SEQ ID NO: 17702
  derived and/or modified sequence opt3 from VP1__Norovirus__AGS08040

SEQ ID NO: 18306 - RNA, 1623 nt, Artificial Sequence; identical to SEQ ID NO: 17854
  derived and/or modified sequence opt3 from VP1__Norovirus__AGS08041

SEQ ID NO: 18307 - RNA, 1623 nt, Artificial Sequence; identical to SEQ ID NO: 17662
  derived and/or modified sequence opt3 from VP1__Norovirus__AGS08042

SEQ ID NO: 18308 - RNA, 1623 nt, Artificial Sequence
  derived and/or modified sequence opt3 from VP1__Norovirus__AGS08043
augaagauggccagcuccgacgcuaaccccucugauggcucaaccgcaaaucuggugccugaggucaguaacgaaguuauggcccucgagccagugguaggggcggcuaucgccgcaccgguggccggacagcaaaaugucauugaccccuggauaagaaacaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacaguacaauuaaguugaucgcaaugcucuauacuccacugcgugcuaauuccgccggggaugacguguucaccgucucuugcagaguucugacaaggcccagcccggauuuugacuucauuuuucucgugccucccaccguagaaucccggacuaaaccauucucagugccuaucuuaacagucgaggaaaugaccaacagucgcuuucccauaccacuggagaaacuuuucacgggacccagcucugcguucgugguucagccucagaacgguagauguacuaccgauggcguguugcuggggacaacucaacuauccccagucaauauuugcaccuuuaggggagacgugacacauaucccgggcucacacaacuacaccaugaaucucgccagccagaacuggaauaguuaugaucccacggaggaaauuccugcaccacuggguacucccgacuucguagggaagauccagggaguucuuacacagaccacuucuacaaacggcuccacccggggccauaaggcuacgguguacaccgggagcgccgacuuuucgccuaagcugggacgcguccaauucgcuacagauacuaauaacgacuuugagaccaaucagaacacaaaauucacuccagugggugucauccaggauggcucuaccacaccccgaaaugaaccgcaacaguggguguugccuuccuacucagggagaaacauucacaauguucaccucgccccagcaguggcccccaccuuuccuggagagcagcuguuauucuuuaggaguacuaugcccggcuguagcgguuauccaaacauggaccuggauugccuccuuccucaggaauggguacaauacuucuaucaggaggcugcgcccgcacaguccgacgucgcccuguugcgguuugugaauccagauacggggcguguucuauucgaguguaagcugcauaaaucuggcuacauaacaguggcucacaccggacagcaugaccucgucaucccgccuaacggcuauuuucgcuucgauagcugggugaaccaauucuacacucuggcccccauggggaauggaaccgguagaaggcgggcacuuuga

SEQ ID NO: 18309 - RNA, 1623 nt, Artificial Sequence
  derived and/or modified sequence opt3 from VP1__Norovirus__AGS08044
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggaacucauaugaucccacggaggaaauuccugcaccacuggguacucccgacuucguagggaagauccagggaguucuuacacagaccacuagcacaaauggcaguacccggggccauaaggcuacgguguacaccgggucugccgacuuuuccccuaagcugggacgcguccaauucgcuacagauacuaauaacgacuuugagaccaaucagaacacaaaauucacuccagugggugucauccaggauggcagcaccacaccccgaaaugaaccgcaacaguggguguugccuucguacucugggagaaacauucacaauguucaccucgccccagcaguggcccccaccuuuccuggagagcagcuguuauucuuuagguccacuaugcccggcuguucagguuauccaaacauggaccuggauugccuccuuccucaggaauggguacaauacuucuaucaggaggcugcgcccgcacagagugacgucgcccuguugcgguuugugaacccagauacggggcguguucuauucgaguguaagcugcauaaaagcggcuacgugacagucgcucacaccggacagcaugaccucgugauaccgccuaauggcuauuuucgcuucgauuccuggguaaaccaauucuacacucuggcccccauggggaauggaaccgguagaaggcgggcacuuuga

SEQ ID NO: 18310 - RNA, 1623 nt, Artificial Sequence
  derived and/or modified sequence opt3 from VP1__Norovirus__AGS08045
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaguuccccuggagaaacuuuucacgggaccuuccucagcguucgugguccagccacagaacgguagauguacuaccgauggcguguugcuggggacaacucaacuaaguccgguaaauaucugcaccuuuaggggagacguuacacauauaaccggcagccggaacuacacgaugaaucucgccucucagaacuggaacuccuaugaucccacugaggaaauuccugcaccacuggguacacccgacuucguggggaagauccagggaguccuuacccagacuacacgcaccaauggcucaacgcgaggccacaaggcuaccguguacacagggagcgccgacuuuaguccuaagcugggaagaguccaauucgcuacugauaccgacaaugauuuugagacaaaccagaauacuaaauucaccccaguggguguuauucaggacggcucuacaacccccaggaacgaaccgcaacaguggguguugccuuccuacagcgggcggaauauccauaacguacaccucgccccagcagucgcccccacuuuuccuggagagcagcuguuauucuuucguucgacgaugcccggcuguucugguuauccaaauauggaucuggacugccuccuuccucaggaaugggugcaauacuucuaucaggaggcugcgcccgcacaguccgauguugcccuguugcgcuuugugaacccagacacagggagaguccuauucgaguguaagcugcacaaaucaggcuacgugaccguagcucauacuggacagcacgaucucgugaucccgccuaacggcuauuuuagguucgacaguuggguuaaucaauucuacacccuggcccccauggggaacggaacaggucggcgacgcgcacuuuga

SEQ ID NO: 18311 - RNA, 1623 nt, Artificial Sequence
  derived and/or modified sequence opt3 from VP1__Norovirus__AGS08047
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccgucuuaacaguggaggaaaugaccaauucccgcuuuccaaucccccuggagaaacuuuucacggggccuucaagugcguucguugugcagccacagaacggaagauguacuaccgauggugucuugcugggcacaacucaacuaagcccggugaauauaugcaccuuuaggggagacguaacacauauuucugggucccggaacuacaccaugaaucucgccucacagaacuggaauagcuaugaucccacggaggaaaucccugcaccacugggcacucccgacuucguugguaagauucagggggugcuuacacagaccacucgcacagacggaaguacccgaggccacaaggcuacggucuacaccggcucugccgauuuuuccccuaagcuggggagagugcaauucgcuacagacacugauaacgacuuugucaccaaucagaacacaaaauucacuccagugggaguuauccaggaugguagcaccacacccaggaaugagccgcaacaguggguguugccuucguacucuggccggaacacccauaauguacaccucgccccagcagucgcccccacuuuuccuggggaacagcuguuauucuuucguuccacgaugcccggauguucaggcuauccaaacauggaccuggauugccuccuuccucaggagugggugcaauacuucuaucaggaagcugcgcccgcacagagugacguugcccuguugcgcuuugugaauccagauacagguagaguccuauucgaguguaagcugcacaaaagcggguacgugaccguagcucauacuggccagcacgaccucgugaucccgccuaacggauauuuuagguucgauuccuggguuaaccaauucuacacccuggcccccaugggcaaugggacaggacggcgacgcgcacuuuga

SEQ ID NO: 18312 - RNA, 1623 nt, Artificial Sequence; identical to SEQ ID NO: 17854
  derived and/or modified sequence opt3 from VP1__Norovirus__AGS08048

SEQ ID NO: 18313 - RNA, 1623 nt, Artificial Sequence
  derived and/or modified sequence opt3 from VP1__Norovirus__AGS08050
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcaguacuacccacaggaacgagccccaacaguggguauugccgucuuacuccgggcggaauacaccuaacguccaccucgccccagcuguggcgcccaccuuuccuggagaacagcuguuauucuuucguagcacuaugcccggcuguucggguuauccaaauauggaccuggauugccuccuuccucaggaguggguucaauacuucuaucaggaggcagcccccgcucagucugacguggcccuguugcgcuuugucaacccagauacggggagagugcuauucgaauguaagcugcauaaauccggcuacguaacaguggcacacaccggacagcaugaccucguuauuccgccuaauggcuauuuuagguucgauucaugggucaaccaauucuacacucuggcccccauggggaacggaaccggucggcgacgcgcucuuuga

SEQ ID NO: 18314 - RNA, 1623 nt, Artificial Sequence
  derived and/or modified sequence opt3 from VP1__Norovirus__AGS08051
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcgccuuuaggggagacguaacccauauuagcggcucucggaacuacacaaugaaucucgcaucccagaacuggaacucauaugaucccaccgaggaaaucccugcuccacuggguacgcccgacuucguugggaagauucagggaaugcuuacucagacaacccgcacugacggcagcacacgaggccacaaggccaccguguacacggggagugcugauuuuucuccuaagcugggaagaguccaauucgccaccgacacagauaaugacuuugugacuaaucagaacaccaaauucacaccagucggugugauccaggauggcuccacuacccccaggaaugagccgcaacaguggguuuugccuagcuacucggggcggaacacacauaaugugcaccucgcaccagccguagcucccaccuuuccuggagaacagcuguuauucuuucguucuacuaugcccggcuguuccgguuauccaaacauggaccuggauugccuccuuccucaggaguggguccaauacuucuaucaggaagcggcacccgcccagucagacguggcucuguugcgcuuuguuaauccagauacggggagagugcuauucgaguguaagcugcacaaaaguggcuacgucacaguggcccauaccggacagcacgaccucguaaucccgccuaacggcuauuuuagguucgauagcugggugaaccaauucuacacucuggcacccauggggaauggaaccggucggcgacgcgcccuuuga

SEQ ID NO: 18315 - RNA, 1623 nt, Artificial Sequence
  derived and/or modified sequence opt3 from VP1__Norovirus__AGS08052
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgguacagacacugaucaugacuuugaggcaaaccagaauaccaaauucacaccaguuggcgugauccaggaugggaguacuacccacaggaacgaaccccaacaguggguauugccgucuuacuccggacggaauacaccuaacguccaccucgccccagcuguggcgcccaccuuuccuggcgagcagcuguuauucuuucguagcacuaugcccgguuguucgggguauccaaauauggaccuggauugccuccuuccucaggaauggguucaauacuucuaucaggaggcagcccccgcucagucugacguggcccuguugcgcuuugucaacccagauacgggcagagugcuauucgaguguaagcugcauaaauccggauacguaacaguggcacacaccggccagcaugaccucguuauuccgccuaauggguauuuuagguucgauucaugggucaaccaauucuacacucuggcccccaugggaaacgguaccggccggcgacgcgcucuuuga

SEQ ID NO: 18316 - RNA, 1623 nt, Artificial Sequence
  derived and/or modified sequence opt3 from VP1__Norovirus__AGS08054
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucgccgaucagaauaccaaauucacaccaguggguguuauccaggacggcuccacuacccccaggaacgagccgcaacaguggguguugccuagcuacucggggcggaauacacauaacguacaccucgcaccagccgucgcucccaccuuuccuggagaacagcuguuauucuuucguucuacuaugcccggcuguuccgguuauccaaauauggaucuggacugccuccuuccucaggagugggugcaauacuucuaucaggaagcggcacccgcccagucagauguugcucuguugcgcuuugugaacccagacacggggagaguccuauucgaguguaagcugcacaaaaguggcuacgugacaguagcccauaccggacagcacgaucucgugaucccgccuaauggcuauuuuagguucgacagcuggguuaaccaauucuacacucuggcacccauggggaacggaaccggucggcgacgcgcccuuuga

SEQ ID NO: 18317 - RNA, 1623 nt, Artificial Sequence
  derived and/or modified sequence opt3 from VP1__Norovirus__AGS08056
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaagcaaaccagaauaccaaauucacaccaguuggugugauccaggauggcgggacuacccaucggaacgagccccaacaguggguauugccgaguuacucuggacguaauacaccuaacguccaccucgccccagcuguggcgcccaccuuuccuggcgaacagcuguuauucuuucgcuccacuaugcccgguuguagcggguauccaaauauggaccuggauugccuccuuccucaggaguggguucaauacuucuaucaggaggcagcccccgcucagucggacguggcccuguugagauuugucaacccagauacgggcagggugcuauucgaauguaagcugcacaaaucuggauacguaacaguggcacauaccggccagcacgaccucguuauuccgccuaauggguauuuucgguucgauuccugggucaaccaauucuacacucuggcccccaugggaaacgguaccggccgacgcagagcucuuuga

SEQ ID NO: 18318 - RNA, 1623 nt, Artificial Sequence
  derived and/or modified sequence opt3 from VP1__Norovirus__AGS08057
augaagauggccagcuccgacgcucaccccucugauggcucaaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucacaucauaguugacgugcgccaacuggagccaguccuuaucccccugccugaugugcgaaauaacuuuuaucauuacaaucagucaaacgacccaacaauuaaguugaucgcaaugcucuauacuccccugcgugcuaauaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgauggcgucuugcuggggacaacucaacuaaguccggugaacauaugcaccuuuaggggagacguaacacacauuagcggcucucggaauuacaccaugaaccucgccucccagaauuggaacucauaugaucccacggaggaaaucccugcaccacuggguacucccgacuucguugggaagauucagggagugcuuacacagaccacucgcgcugacggcagcacacgaggccauaaggccaccgucuacacggggagugcugauuuuucuccuaagcugggaagagugcaauucgccaccgacacagauaaugacuuugucgcaaaccagaauacuaaauucaccccaguggguguuauccaggauggcuccacaacucccaggaacgagccgcaacaguggguguugccuagcuacucggggcggaauacccacaacguacaccucgccccagcugucgcgcccacauuuccuggagaacagcuguuauucuuucguucuaccaugcccggcuguuccgguuauccaaauauggaccuggauugccuccuuccucaggagugggugcaauacuucuaucaggaagcagcccccgcucagucagacguugcccuguugcgcuuugugaacccagauacugggagaguccuauucgaguguaagcugcauaaaaguggcuacgugacgguagcacacacaggacagcaugaccucgugaucccgccuaauggcuauuuuagguucgauagcuggguuaaccaauucuacacccuggcccccauggggaacggaacuggucggcgacgcgcucuuuga

SEQ ID NO: 18319 - RNA, 1623 nt, Artificial Sequence
  derived and/or modified sequence opt3 from VP1__Norovirus__AGS08058
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggaggcagccccugcucagagcgacguggcccuguugcgcuuugucaaucccgauacgggcagagugcuauucgaauguaagcugcacaaaucgggauacguaacaguggcacauaccggccagcacgaccucguuauuccaccgaacggguauuuuagguucgauucuugggucaaccaauucuacacucuggccccuaugggaaaugguaccggccggcgacgcgcuguguga

SEQ ID NO: 18320 - RNA, 1623 nt, Artificial Sequence
  derived and/or modified sequence opt3 from VP1__Norovirus__AGS08059
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggaacgcuccucugggaccagauuugaaucccuacuuaagccaccuggcccggauguauaacggcuacgcggguggguucgaagugcaggucauucuagcaggaaaugccuuuacagcuggcaaagugaucuucgccgcaguaccuccaaacuuuccgacugagggccucucccccucucagguuacgauguucccucauauuguggucgacgugcgccaacuggagccagugcuuaucccccugccugauguccgaaauaacuuuuaucacuacaaucagucgaacgacccaaccauaaaguugaucgcuaugcucuauacaccccugcgugccaacaaugcgggggaugacguuuucacugugucaugcagaguacugaccaggccgagcccugauuuugacuucauuuuucucgugcccccaacagucgaaagucggaccaaaccuuucuccgugcccguuuuaacuguggaggaaaugacaaacucucgcuuuccaaucccccuggagaaacuuuucaccggaccuagcuccgccuucgucgugcagccacagaaugguagauguacgacugauggcguauugcuggggaccacacaacuaucaccgguuaacauuugcacuuuuaggggagacgugacccauaucacaggcagucggaauuacaccaugaaccucgcaagccagaauuggaacaauuaugaucccacggaggaaauaccugcuccacuggguacucccgacuucgucgggaagauucagggagugcuuacacagaccacucgcacagacggcucuacccgaggccacaaggccacggucuacaccggguccgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgucauacagcggacggaauacacacaacguccaucucgccccugcuguggcgccaaccuuucccggcgaacagcuguuauucuuucguaguacuaugccugguuguucuggguaucccaauauggaccuggauugccuccuuccacaggaguggguucaauacuucuaucaggaggcagccccugcucaguccgacguggcccuguugcgcuuugucaaccccgauacgggcagagugcuauucgaauguaagcugcacaaaagcggauacgcaacaguagcccauaccggccagcacgaccucgugauuccaccgaacggguauuuuagguucgauucguggguuaaucaauucuacacucuggcuccuaugggaaacgguaccggccggcgacgcgccgucuga

SEQ ID NO: 18321 - RNA, 1623 nt, Artificial Sequence
  derived and/or modified sequence opt3 from VP1__Norovirus__AGS08060
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacaccuaauguccaccucgccccagcuguggcgcccaccuuuccuggcgaacagcuguuauucuuucguucuacuaugcccgguuguuccggguauccaaacauggaccuggauugccuccuuccucaggaguggguucaauacuucuaucaggaggcagcccccgcucagagcgacguggcccuguugcgcuuugucaauccagauacgggcagagugcuauucgaauguaagcugcauaaaucgggauacguaacaguggcacacaccggccagcaugaccucguuauuccgccuaacggguauuuuagguucgauucuugggucaaccaauucuacacucuggcccccaugggaaaugguaccggccggcgacgcgcucuuuga

SEQ ID NO: 18322 - RNA, 1623 nt, Artificial Sequence; identical to SEQ ID NO: 17662
  derived and/or modified sequence opt3 from VP1__Norovirus__AGS08061

SEQ ID NO: 18323 - RNA, 1623 nt, Artificial Sequence; identical to SEQ ID NO: 18317
  derived and/or modified sequence opt3 from VP1__Norovirus__AGS08062

SEQ ID NO: 18324 - RNA, 1623 nt, Artificial Sequence; identical to SEQ ID NO: 18309
  derived and/or modified sequence opt3 from VP1__Norovirus__AGS08063

SEQ ID NO: 18325 - RNA, 1623 nt, Artificial Sequence; identical to SEQ ID NO: 17854
  derived and/or modified sequence opt3 from VP1__Norovirus__AGS08064

SEQ ID NO: 18326 - RNA, 1623 nt, Artificial Sequence; identical to SEQ ID NO: 17702
  derived and/or modified sequence opt3 from VP1__Norovirus__AGS08065

SEQ ID NO: 18327 - RNA, 1623 nt, Artificial Sequence; identical to SEQ ID NO: 18309
  derived and/or modified sequence opt3 from VP1__Norovirus__AGS08066

SEQ ID NO: 18328 - RNA, 1623 nt, Artificial Sequence; identical to SEQ ID NO: 17854
  derived and/or modified sequence opt3 from VP1__Norovirus__AGS08067

SEQ ID NO: 18329 - RNA, 1623 nt, Artificial Sequence
  derived and/or modified sequence opt3 from VP1__Norovirus__AGS08068
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaagcgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauuucuggcucccggaauuacaccaugaaccucgccucacagaauuggaacagcuaugaucccacggaggaaaucccugcaccacuggguacucccgacuucguugggaagauucagggagugcuuacacagaccacucgcacagacggcaguacccgaggccacaaggcuacggucuacaccgggucugccgauuuuuccccuaagcugggaagagugcaauucgcuacagacacugauaaugacuuugucaccaaccagaauacaaaauucacuccaguggguguuauccaggauggcagcaccacacccaggaacgagccgcaacaguggguguugccuucguacucugggcggaauacccauaacguacaccucgccccagcagucgcccccacuuuuccuggagaacagcuguuauucuuucguuccacgaugcccggcuguucagguuauccaaauauggaccuggauugccuccuuccucaggagugggugcaauacuucuaucaggaagcugcgcccgcacagagugacguugcccuguugcgcuuugugaacccagauacagggagaguccuauucgaguguaagcugcacaaaagcggcuacgugaccguagcucauacuggacagcacgaccucgugaucccgccuaauggcuauuuuagguucgauuccuggguuaaccaauucuacacccuggcccccauggggaacggaacaggucggcgacgcgcacuuuga

SEQ ID NO: 18330 - RNA, 1623 nt, Artificial Sequence
  derived and/or modified sequence opt3 from VP1__Norovirus__AGS08069
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauacccauaacgugcaccucgccccagcaguagcccccacuuuuccuggagagcagcuguuauucuuucguucuacgaugcccggcuguuccgguuauccaaauauggaucuggacugccuccuuccucaggaauggguccaauacuucuaucaggaggcugcgcccgcacagucagauguggcccuguugcgcuuuguuaacccagacacagggagagugcuauucgaguguaagcugcacaaaaguggcuacgucaccguggcucauacuggacagcacgaucucguaaucccgccuaacggcuauuuuagguucgacagcugggugaaucaauucuacacccuggcccccauggggaacggaacaggucggcgacgcgcacuuuga

SEQ ID NO: 18331 - RNA, 1623 nt, Artificial Sequence
  derived and/or modified sequence opt3 from VP1__Norovirus__AGS08070
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucggagugcaggucauucuagcaggcaacgccuuuacagcuggcaaagugaucuucgccgcaguaccuccaaauuuuccgacugaagggcucucucccucgcagguuacgauguucccucauauuguggucaacgugcgccaacuggagccagugcuuaucccccugccugacguccgaaauaacuuuuaucacuacaaucagucaaacgauccaaccauaaaguugaucgcuaugcucuauacaccccugcgugccaacaaugcgggagacgauguuuucacugugagcugcagaguacugaccaggccgaguccugacuuugauuucauuuuucucgugcccccaacagucgagucccggaccaaaccuuucucugugcccguuuuaacuguggaagagaugacaaacagccgcuuuccaaucccccuggaaaaacuuuucaccgguccuuccucagccuucgucgugcagccacagaauggcagauguacgacugacgggguauugcugggaaccacacaacuaaguccgguuaacauuugcacuuuuaggggcgaugugacccauaucacagguagccggaauuacaccaugaaccucgcaucucagaauuggaacaauuaugaccccacggaggagacuccugcuccacuggggacacccgauuucgucggaaagauacagggcgugcuuacccagacuacacgcaccgacggcuccacgcgagggcacaaggccaccgucuacacaggaucagcugacuuugccccuaagcuggguagagugcaauucgaaacugauaccgaccaugauuuugaggcaaaccagaauacaaaauucacuccaguuggcgugauucaggacgggagcaccacacacaggaacgaaccccaacaguggguauugccgaguuacucuggacggaauacccacaacguccaucucgccccugcuguggcgccaacuuuucccggcgagcagcuguuauucuuucguuccacgaugccugguuguagcggguaucccaauauggaucuggacugccuccuuccacaggaauggguucaauacuucuaucaggaggcagccccugcucagucggauguggcccuguugcgcuuugucaaccccgacacaggcagagugcuauucgaguguaagcugcacaaaucuggauacguaaccguggcacucacuggccagcaugaucugguuaucccaccgaacggguauuuuagguucgacuccugggucaaucaauucuacacccuugccccuaugggaaacgguacaggccggcgacgcgcuguguga

SEQ ID NO: 18332 - RNA, 1623 nt, Artificial Sequence; identical to SEQ ID NO: 18317
  derived and/or modified sequence opt3 from VP1__Norovirus__AGS08071

SEQ ID NO: 18333 - RNA, 1623 nt, Artificial Sequence; identical to SEQ ID NO: 17702
  derived and/or modified sequence opt3 from VP1__Norovirus__AGS08072

SEQ ID NO: 18334 - RNA, 1623 nt, Artificial Sequence; identical to SEQ ID NO: 18225
  derived and/or modified sequence opt3 from VP1__Norovirus__AGS08073

SEQ ID NO: 18335 - RNA, 1623 nt, Artificial Sequence; identical to SEQ ID NO: 18309
  derived and/or modified sequence opt3 from VP1__Norovirus__AGS08074

SEQ ID NO: 18336 - RNA, 1623 nt, Artificial Sequence; identical to SEQ ID NO: 17854
  derived and/or modified sequence opt3 from VP1__Norovirus__AGS08076

SEQ ID NO: 18337 - RNA, 1623 nt, Artificial Sequence; identical to SEQ ID NO: 17854
  derived and/or modified sequence opt3 from VP1__Norovirus__AGS08079

SEQ ID NO: 18338 - RNA, 1623 nt, Artificial Sequence; identical to SEQ ID NO: 18309
  derived and/or modified sequence opt3 from VP1__Norovirus__AGS08080

SEQ ID NO: 18339 - RNA, 1623 nt, Artificial Sequence
  derived and/or modified sequence opt3 from VP1__Norovirus__AGS08081
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggaacucauaugaucccacggaggaaauuccugcaccacuggguacucccgacuucguagggaagauccagggaguucuuacacagaccacuagcacaaauggcaguacccggggccauaaggcuacgguguacaccgggucugccgacuuuuccccuaagcugggacgcguccaauucgugacagauacuaauaacgacuuugagaccaaucagaacacaaaauucacuccagucggugugauccaggauggcagcaccacaccccgaaaugaaccgcaacaguggguuuugccuucguacucugggagaaacauucacaaugugcaccucgcuccagccguagcacccaccuuuccuggagagcagcuguuauucuuuagguccacuaugcccggcuguucagguuauccaaacauggaccuggauugccuccuuccucaggaauggguccaauacuucuaucaggaggccgcucccgcgcagagugacguggcacuguugcgguuuguuaacccagauacggggcgugugcuauucgaguguaagcugcauaaaagcggcuacgucacaguggcccacaccggacagcaugaccucguaauaccgccuaauggcuauuuucgcuucgauuccugggugaaccaauucuacacucuggcucccauggggaauggaaccgguagaaggcgggcccuuuga

SEQ ID NO: 18340 - RNA, 1623 nt, Artificial Sequence
  derived and/or modified sequence opt3 from VP1__Norovirus__AGS08082
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuacaccuaagcugggaagagugcaauucgcuacugacaccgauaaugacuuugucacaaaucagaacacuaaauucaccccaguggguguuauccaggauggcucuacaacccccaggaaugagccgcaacaguggguguugccuuccuacagcgggcggaacacucauaauguacaccucgccccagcagucgcccccacguuuccuggagaacagcuguuauucuuucguucgacaaugcccggcuguucugguuauccaaacauggaccuggauugccuccuuccucaggagugggugcaauacuucuaucaggaagcugcgcccgcacaguccgacguugcccuguugcgcuuugugaauccagauaccgggagaguccuauucgaguguaagcugcacaaaucaggcuacgugacuguagcucauaccggacagcacgaccucgugaucccgccuaacggcuauuuuagguucgauaguuggguuaaccaauucuacacacuggcccccauggggaauggaaccggucggcgacgcgcacuuuga

SEQ ID NO: 18341 - RNA, 1623 nt, Artificial Sequence; identical to SEQ ID NO: 17854
  derived and/or modified sequence opt3 from VP1__Norovirus__AGS08083

SEQ ID NO: 18342 - RNA, 1623 nt, Artificial Sequence
  derived and/or modified sequence opt3 from VP1__Norovirus__AGS08084
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucauaugacccaacaauuaaguugaucgcaaugcucuacacuccccugcgugcuaauaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgauggcgucuugcuggggacaacucaacuaaguccggugaacauaugcaccuuuaggggagacguaacacauauucccggcagccacaauuauaccaugaaccucgccucucagaauuggaacuccuacgauccuacggaggaaaucccagcaccccuggguacuccugacuucguugggaagauucagggagugcuuacacagaccacuaagacaaauggcucaacccggggccauaaggcuacggucuacaccgggagcgccgacuuuaguccaaaacugggacgcgugcaauucgcuacagauacuaacaaugacuuugagaccaaccagaauacaaaguucacucccgucggugugauccaggauggcucuaccacaccgcgaaacgaaccucaacaguggguuuugccauccuauagcgggagaaauauccacaacgugcaccucgcccccgcaguagccccuaccuuucccggagagcagcuguuauucuuuaggucgacuaugccaggcuguucugguuacccuaauauggaccuggauugccuccuuccccaggaauggguccaauauuucuaccaggaggcugcgccagcacaguccgacguggcccuguugcgguuuguuaacccggauacggggcgugugcuauucgaguguaaacugcauaagucaggcuaugucacaguggcuuacaccggacagcacgaccucguaauuccucccaacggcuauuuucgcuucgauaguugggugaaucaauucuacacucuggccccaauggggaacggaaccgguagaaggcgggcacuuuga

SEQ ID NO: 18343 - RNA, 1623 nt, Artificial Sequence
  derived and/or modified sequence opt3 from VP1__Norovirus__AGS08085
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggaggcagccccugcucagagcgacguggcccuguugcgcuuugucaaucccgauacgggcagagugcuauucgaauguaagcugcacaaaucgggauacgcaacaguagcccauaccggccagcacgaccucgugauuccaccgaacggguauuuuagguucgauucuuggguuaaccaauucuacacucuggcuccuaugggaaaugguaccggccggcgacgcgccgucuga

SEQ ID NO: 18344 - RNA, 1623 nt, Artificial Sequence; identical to SEQ ID NO: 18309
  derived and/or modified sequence opt3 from VP1__Norovirus__AGS08086

SEQ ID NO: 18345 - RNA, 1623 nt, Artificial Sequence
  derived and/or modified sequence opt3 from VP1__Norovirus__AGS08087
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccagcacuauccuuugguccgccccucuggggccagauuugaaccccuacuuaucucaccuggcucggauguauaauggauacgccggcgguuucgaggugcaggucauucuagcggggaacgcauuuacggccggaaaaaucauuuucgcugccgugccuccaaauuuuccgaccgaaggccucucgcccucacagguaacaauguucccucauaucauaguugacgugcgccaacuggagccaguccuuaucccccugccugaugugcgaaacaauuuuuaucacuacaaccagagcaaugacccaacuauuaaguugaucgcaaugcucuauacgccccugcgugcuaacaacgccggcgaugacguguucacagucaguugcagaguucugaccaggccguccccugauuuugacuucauuuuucucgugcccccaacuguagagucucggacaaaaccuuucagcgugcccgucuuaaccguggaagagaugaccaauucccgcuuuccaaucccccuggaaaaacuuuucacugggccuucaagugcguucguugugcagccacagaacggaagauguaccacagauggugucuugcugggcacuacccaacuaagcccggugaauauaugcacauuuaggggagacguaacccauauuucugggucccggaacuacacgaugaaucucgccucacagaacuggaauagcuaugaucccacugaggagaucccugcaccacugggcacacccgacuucguugguaagauucagggggugcuuacccagacuacacgcaccgacggaaguacgcgaggccacaaggcuaccgucuacacaggcucugccgauuuuuccccuaagcuggggagagugcaauucgcuacugacaccgauaacgacuuugucacaaaucagaacacuaaauucaccccagugggaguuauccaggaugguagcacaacccccaggaaugaaccgcaacaguggguguugccuucguacucuggccggaacauccauaauguacaccucgccccagcagucgcccccacuuuuccuggggagcagcuguuauucuuucguuccacgaugcccggauguucaggcuauccaaacauggaccuggauugccuccuuccucaggaaugggugcaauacuucuaucaggaggcugcgcccgcacagagugacguugcccuguugcgcuuugugaauccagauacagguagaguccuauucgaauguaagcugcacaaaagcggguacgugaccguagcucauacuggccagcacgaccucgugauuccgccuaacggauauuuuagguucgauuccuggguuaaccaauucuacacccuggcccccaugggcaaugggacaggacggcgacgcgcacuuuga

SEQ ID NO: 18346 - RNA, 1623 nt, Artificial Sequence; identical to SEQ ID NO: 18309
  derived and/or modified sequence opt3 from VP1__Norovirus__AGS08088

SEQ ID NO: 18347 - RNA, 1623 nt, Artificial Sequence; identical to SEQ ID NO: 17662
  derived and/or modified sequence opt3 from VP1__Norovirus__AGS08089

SEQ ID NO: 18348 - RNA, 1623 nt, Artificial Sequence; identical to SEQ ID NO: 17854
  derived and/or modified sequence opt3 from VP1__Norovirus__AGS08090

SEQ ID NO: 18349 - RNA, 1623 nt, Artificial Sequence
  derived and/or modified sequence opt3 from VP1__Norovirus__AGS08091
augaagauggccagcuccgacgcuaaccccaccgauggcucugcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaaaucauuuucgccgcagugccuccaaauuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaacgcgggggaugacguguucaccgucagcugcagaguucugacaaggcccaguccggauuuugacuucauuuuucucgugccucccaccguagaaucccggacuaaaccauucucugugccugucuuaacaguggaggaaaugaccaauagccgcuuucccaucccacuggagaaacuuuucacgggacccuccucagccuucguugugcagccucagaacgguagauguacuaccgauggcgucuugcuggggacaacucaacuaaguccagugaauauaugcaccuuuaggggagacguaacacauauuaccggcagccggaacuacacgaugaaucucgcaucucagaacuggaauaacuaugauccgacugaggaaacacccgcuccucuggguaccccagacuucguugggaagauccagggaaugcuuacucagacaacccgcacggacggcuccacccgaggccacaaggccacaguguacacugggucagcugauuuugcccccaagcugggaagaguccaauucgagaccgacacagaucaugacuuugaagcaaaucagaacacuaaauucaccccugugggugucauucaggauggcagcacaacccacaggaaugagccacaacaguggguguugcccaguuacucugggcggaacacucacaauguucaucucgccccggcuguggcgccuacguuuccaggagaacagcuguuauucuuucguuccacaaugcccggcuguagcgguuauccuaacauggaccuggauugccuccuuccccaggaguggguacaauacuucuaucaggaggcagccccagcucagucggacgucgcccuguugcgcuuugugaauccugauaccgggagaguucuauucgaauguaagcugcacaaaucuggcuacgugacugucgcacauaccggacagcacgaccucgugauucccccaaacggcuauuuuagguucgauuccuggguaaaccaauucuacacacuggccccgauggggaauggaaccggucggcgacgcgugguuuga

SEQ ID NO: 18350 - RNA, 1623 nt, Artificial Sequence; identical to SEQ ID NO: 17854
  derived and/or modified sequence opt3 from VP1__Norovirus__AGS08092

SEQ ID NO: 18351 - RNA, 1623 nt, Artificial Sequence; identical to SEQ ID NO: 18309
  derived and/or modified sequence opt3 from VP1__Norovirus__AGS08093

SEQ ID NO: 18352 - RNA, 1623 nt, Artificial Sequence; identical to SEQ ID NO: 17702
  derived and/or modified sequence opt3 from VP1__Norovirus__AGS08094

SEQ ID NO: 18353 - RNA, 1623 nt, Artificial Sequence; identical to SEQ ID NO: 17702
  derived and/or modified sequence opt3 from VP1__Norovirus__AGS08095

SEQ ID NO: 18354 - RNA, 1623 nt, Artificial Sequence; identical to SEQ ID NO: 18317
  derived and/or modified sequence opt3 from VP1__Norovirus__AGS08096

SEQ ID NO: 18355 - RNA, 1623 nt, Artificial Sequence
  derived and/or modified sequence opt3 from VP1__Norovirus__AGS08097
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacauuauagaccccuggaucagaaauaacuucguccaggcuccugguggcgaauuuacagugaguccaaggaaugcacccggggagauucuuuggagcgccccucugggaccagauuugaaccccuacuuaucccaccuggcucggauguauaauggcuacgccgguggguucgaaguucaggugauccuagcgggaaacgcauuuacugccggcaaaauuaucuucgcugccgucccuccaaauuuuccgacggagggccucucucccucacaggugaccauguucccucauauaaucguagacguucgccaacuggagccagugcuuauuccccugccugauguccgaaacaauuuuuaucacuacaaccagucgaaugacagcacaaucaaguugauugcaaugcucuauacuccacugcgugcuaacaacgccggggaugacguguucaccgugaguugcagaguccugacaaggcccuccccggauuuugacuucaucuuucucguuccucccaccguggaaucucggacuaaaccauucagcguaccuguguuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucucuggcucccggaacuacaccaugaaucucgccucacagaacuggaauagcuaugauccgacggaggaaauucccgcaccucuggguacuccagacuucguagggaagauccagggaguucuuacacagaccacucgcacagacggcaguacccgaggccacaaggcuacgguguacaccgggucugccgauuuuucccccaagcugggaagaguccaauucgcuacagacacugauaacgacuuugugaccaaucagaacacaaaauucacuccugucggugugauccaggauggcagcaccacaccaaggaaugagccccaacaguggguuuugccgucguacucugggcggaacacccauaaugugcaccucgccccugcaguagccccaacuuuucccggagaacagcuguuauucuuucguuccacgaugccuggcuguucagguuaucccaacauggaccuggauugccuccuuccacaggaguggguccaauacuucuaucaggaagcugcgccugcacagagugacguggcccuguugcgcuuuguuaaucccgauacagggagagugcuauucgaguguaagcugcacaaaagcggcuacgucaccguggcucauacuggacagcacgaccucguaauuccaccgaacggcuauuuuagguucgauuccugggugaaccaauucuacacccuggccccuauggggaauggaacaggucggcgacgcgcacuuuga

SEQ ID NO: 18356 - RNA, 1623 nt, Artificial Sequence
  derived and/or modified sequence opt3 from VP1__Norovirus__AGS08098
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucacaacuacaccaugaaucucgccucccagaacuggaacucauaugaucccacggaggaaaucccugcaccacuggguacucccgacuucguugggaagauucagggagugcuuacacagaccacucggacagacggcagcacccgcggccauaaggcuacggucuacaccgggagugccgauuuuucuccuaagcugggacgagugcaauucgcuacagacacugauaaugacuuugucaccaaucagaacacaaaauucacuccaguggguguuauccaggauggcuccaccacacccagaaaugagccgcaacaguggguguugccuagcuacucggggaggaacacccacaauguacaccucgccccagcagucgcccccacuuuuccuggagaacagcuguuauucuuucggucuacgaugcccggcuguuccgguuauccaaacauggaccuggauugccuccuuccucaggagugggugcaauacuucuaucaggaagcugcgcccgcacagucagacguugcccuguugcguuuugugaauccagauacagggcgcguccuauucgaguguaagcugcauaaaaguggcuacgugaccguagcucacacuggacagcaugaccucgugaucccgccuaacggcuauuuuagauucgauagcuggguuaaccaauucuacacccuggcccccauggggaauggaacagguaggcggcgagcacuuuga

SEQ ID NO: 18357 - RNA, 1623 nt, Artificial Sequence; identical to SEQ ID NO: 17854
  derived and/or modified sequence opt3 from VP1__Norovirus__AGS08099

SEQ ID NO: 18358 - RNA, 1623 nt, Artificial Sequence
  derived and/or modified sequence opt3 from VP1__Norovirus__AGS08100
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucguuucccagaacuggaacucauaugaucccacggaggaaaucccugccccacuggguacucccgacuucguggggaagauucagggaguccuuacacagaccacucgcacaaauggcagcacccgaggccacaaggcaacgguguacaccgggagugcugacuuuucuccuaagcugggaagaguccaauucgccacagauacugacaaugauuuugagaccaaccagaauacaaaauucacuccaguggguguuauccaggacggcuccaccacacccaggaacgaaccgcaacaguggguguugccuagcuacucggggcggaauauccauaacguacaccucgcuccagccgucgcacccaccuuuccuggagagcagcuguuauucuuucguucuacuaugcccggcuguuccgguuauccaaauauggaucuggacugccuccuuccucaggaaugggugcaauacuucuaucaggaggccgcucccgcgcagucagauguugcacuguugcgcuuugugaacccagacacggggagaguccuauucgaguguaagcugcacaaaaguggcuacgugacaguagcccauaccggacagcacgaucucgugauuccgccuaacggcuauuuuagguucgacagcuggguuaaucaauucuacacucuggcucccauggggaacggaaccggucggcgacgcgcccuuuga

SEQ ID NO: 18359 - RNA, 1623 nt, Artificial Sequence
  derived and/or modified sequence opt3 from VP1__Norovirus__AGS08101
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuucuggcucccggaacuacacaaugaaucucgcaucacagaacuggaauagcuaugauccgaccgaggaaauccccgcuccucuggguacgccagacuucguugggaagauucagggagugcuuacucagacaacccgcacugacggcaguacacgaggccacaaggccaccgucuacacggggucugcugauuuuucccccaagcugggaagagugcaauucgccaccgacacagauaacgacuuuaucacuaaucagaacaccaaauucacaccugucggugugauccaggauggcagcacuaccccaaggaaugagccccaacaguggguuuugccgucguacucugggcggaacacacauaaugugcaccucgccccugcaguagcuccaaccuuucccggagaacagcuguuauucuuucguuccacuaugccuggcuguucagguuaucccaacauggaccuggauugccuccuuccacaggaguggguccaauacuucuaucaggaagcggccccugcacagagugacguggcucuguugcgcuuuguuaaucccgauacggggagagugcuauucgaguguaagcugcacaaaccaggcuacgucacaguggcccauaccggacagcacgaccucguaauuccgccuaacggcuauuuuagguucgauagcugggugaaccaauucuacacucuggcacccauggggaauggaaccggucggcgacgcgcccuuuga

SEQ ID NO: 18360 - RNA, 1623 nt, Artificial Sequence; identical to SEQ ID NO: 18265
  derived and/or modified sequence opt3 from VP1__Norovirus__AGS08102

SEQ ID NO: 18361 - RNA, 1623 nt, Artificial Sequence
  derived and/or modified sequence opt3 from VP1__Norovirus__AGS08103
augaagauggccagcuccgacgcucaccccucugauggcucaaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuaguccaaggaacgcacccggggagauccuuuggagcgccccucugggaccagauuugaaucccuacuuaucccaucuggcucggauguauaacggcuacgccgguggguucgaagugcaggucauucuagcgggaaaugcauuuacugccggcaaaaucauuuucgcugccgugccuccaaacuuuccgacggagggccucucucccucgcagguaaccauguucccucacaucauaguugacgugcgccaacuggagccaguccuuaucccccugccugaugugcgaaauaacuuuuaucauuacaaucagucaaacgacccaacaauuaaguugaucgcaaugcucuauacuccccugcgugcuaauaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaacagccgcuuuccaaucccccuggagaaacuuuucacgggaccuuccucagcguucguugugcagccacagaaugguagauguacuaccgauggcgucuugcuggggacaacucaacuaaguccggugaacauaugcaccuuuaggggagacguaacacacauuagcggcucucggaauuacaccaugaaccucgccucccagaauuggaacucauaugaucccacggaggaaaucccugcaccacuggguacucccgacuucguugggaagauucagggagugcuuacacagaccacucgcacagacggcagcacccgaggccauaaggcuacggucuacaccgggagugccgauuuuucuccuaagcugggaagagugcaauucgcuacagacacugauaaugacuuugucaccaaccagaauacaaaauucacuccaguggguguuauccaggauggcuccaccacacccaggaacgagccgcaacaguggguguugccuagcuacucggggcggaauacccacaacguacaccucgccccagcagucgcccccacuuuuccuggagaacagcuguuauucuuucguucuacgaugcccggcuguuccgguuauccaaauauggaccuggauugccuccuuccucaggagugggugcaauacuucuaucaggaagcugcgcccgcacagucagacguugcccuguugcgcuuugugaacccagauacagggagaguccuauucgaguguaagcugcauaaaaguggcuacgugaccguagcucacacuggacagcaugaccucgugaucccgccuaauggcuauuuuagguucgauagcuggguuaaccaauucuacacccuggcccccauggggaacggaacaggucggcgacgcgcacuuuga

SEQ ID NO: 18362 - RNA, 1623 nt, Artificial Sequence; identical to SEQ ID NO: 18355
  derived and/or modified sequence opt3 from VP1__Norovirus__AGS08104

SEQ ID NO: 18363 - RNA, 1623 nt, Artificial Sequence; identical to SEQ ID NO: 18321
  derived and/or modified sequence opt3 from VP1__Norovirus__AGS08105

SEQ ID NO: 18364 - RNA, 1623 nt, Artificial Sequence; identical to SEQ ID NO: 18340
  derived and/or modified sequence opt3 from VP1__Norovirus__AGS08106

SEQ ID NO: 18365 - RNA, 1623 nt, Artificial Sequence; identical to SEQ ID NO: 18309
  derived and/or modified sequence opt3 from VP1__Norovirus__AGS08107

SEQ ID NO: 18366 - RNA, 1623 nt, Artificial Sequence
  derived and/or modified sequence opt3 from VP1__Norovirus__AGS08108
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggucaagcuaugaucccacggaggaaaucccugcaccacuggguacucccgacuucguugggaagauucagggagugcuuacacagaccacucgcacagacggcaguacccgaggccacaaggcuacggucuacaccgggucugccgauuuuuccccuaagcugggaagagugcaauucgcuacagacacugauaaugacuuugucaccaaccagaauacaaaauucacuccaguggguguuauccaggauggcagcaccacacccaggaacgagccgcaacaguggguguugccuucguacucugggcggaauacccauaacguacaccucgccccagcagucgcccccacuuuuccuggagaacagcuguuauucuuucguuccacgaugcccggcuguucagguuauccaaauauggaccuggauugccuccuuccucaggagugggugcaauacuucuaucaggaagcugcgcccgcacagagugacguugcccuguugcgcuuugugaacccagauacagggagaguccuauucgaguguaagcugcacaaaagcggcuacgugaccguagcucauacuggacagcacgaccucgugaucccgccuaauggcuauuuuagguucgauuccuggguuaaccaauucuacacccuggcccccauggggaacggaacaggucggcgacgcgcacuuuga

SEQ ID NO: 18367 - RNA, 1623 nt, Artificial Sequence
  derived and/or modified sequence opt3 from VP1__Norovirus__AGS08109
augaagauggccagcuccgacgcuaaccccucugauggcucagcagccaaucuggugccugaggucaacaaugaaguuauggcgcucgagccaguggcuggggccgcaaucgccgcuccgguagcaggacagcaaaacgugauugaccccuggauaagaaauaacuucguccaggccccugguggcgaauuuaccgugaguccaaggaaugcucccggggagauccuuuggagcgccccucugggaccagauuugaaccccuacuuaucccaccuggcgcggauguauaauggcuacgccgguggguucgaaguucaggugauucuagcaggaaacgcuuuuacagccggcaaagucaucuucgcagcugugccuccaaauuuuccgacugagggccucucucccucgcagguaacgauguucccucauauuguuguggacguccgccaacuggagccagugcuuaucccccugccugaugugcgaaacaauuuuuaucacuacaaccagucaaaugacagcaccauaaaguugaucgccaugcucuauacaccacugcgugcgaacaacgccggggaugacgucuucacuguuaguugcagagugcugaccaggcccuccccggauuuugacuucauuuuucucguaccucccacaguggaaucucggaccaaaccauucagcgucccuguguuaacuguugaggaaaugacaaauucccgcuuucccaucccacuggagaaacuuuucaccggacccucaagugcauucgugguccagccucagaacgguagauguacgacugauggcguguugcuggggaccacacaacuaagcccaguaaauauuugcacuuuuaggggagacguuacccauaucacaggcucucggaacuacaccaugaaucucgcuucccagaacuggaauaacuaugauccgacggaggaaauacccgccccucuggguacuccagacuucguggggaagauucagggaaugcuuacacagaccacucgcacagacggcucaacccgaggccacaaggcuacggucuacaccgggagcgccgauuuugcacccaagcugggaagagugcaauucgagacagacacugaucaugacuuugaagccaaucagaacaccaaauucacaccugucggugugauccaggauggcaguacuacccacaggaaugagccacaacaguggguuuugcccucuuacuccgggcggaacacacacaaugugcaucucgcuccggcgguagcaccuaccuuuccaggagaacagcuguuauucuuucguagcacuaugcccggcuguucggguuauccuaacauggaccuggauugccuccuuccccaggaguggguccaauacuucuaucaggaggccgcuccagcccagucugacguggcacuguugcgcuuuguuaauccugauacggggagagugcuauucgaauguaagcugcacaaauccggcuacgucacaguggcccauaccggacagcacgaccucguaauucccccaaacggcuauuuuagguucgauucaugggugaaccaauucuacacucuggcuccgauggggaauggaaccggucggcgacgcguugucuga

SEQ ID NO: 18368 - RNA, 1623 nt, Artificial Sequence
  derived and/or modified sequence opt3 from VP1__Norovirus__AGS08110
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucacaacuacaccaugaaucucgccucccagaacuggaacucauaugaucccacggaggaaaucccugcaccacuggguacucccgacuucguugggaagauucagggagugcuuacacagaccacuagcacaaauggcaguacccggggccauaaggcuacggucuacaccgggucugccgacuuuuccccuaagcugggacgcgugcaauucgcuacagauacuaauaacgacuuugagaccaaucagaacacaaaauucacuccagucggugugauccaggauggcagcaccacaccccgaaaugaaccgcaacaguggguuuugccuucguacucugggagaaacauccacaaugugcaccucgccccagcaguagcccccaccuuuccuggagagcagcuguuauucuuuagguccacuaugcccggcuguucagguuauccaaacauggaccuggauugccuccuuccucaggaauggguccaauacuucuaucaggaggcugcgcccgcacagagugacguggcccuguugcgguuuguuaacccagauacggggcgugugcuauucgaguguaagcugcauaaaagcggcuacgucacaguggcucacaccggacagcaugaccucguaauuccgccuaauggcuauuuucgcuucgauuccugggugaaccaauucuacacucuggcccccauggggaauggaaccgguagaaggcgggcacuuuga

SEQ ID NO: 18369 - RNA, 1623 nt, Artificial Sequence
  derived and/or modified sequence opt3 from VP1__Norovirus__AGS08111
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggaauauccauaacgugcaccucgcccccgcaguagccccuaccuuucccggagagcagcuguuauucuuucguucgacuaugccaggcuguucugguuauccuaauauggaucuggacugccuccuuccccaggaauggguccaauacuucuaucaggaggcugcgccagcacaguccgauguggcccuguugcgcuuuguuaacccggacacggggagagugcuauucgaguguaagcugcacaaaucaggcuacgucacaguggcucauaccggacaguaugaucucguaauuccucccaacggcuacuuuagguucgacaguugggugaaucaauucuauacucuggccccaauggggaacggaaccggucggcgacgcgcacuuuga

SEQ ID NO: 18370 - RNA, 1623 nt, Artificial Sequence; identical to SEQ ID NO: 17854
  derived and/or modified sequence opt3 from VP1__Norovirus__AGS08112

SEQ ID NO: 18371 - RNA, 1623 nt, Artificial Sequence
  derived and/or modified sequence opt3 from VP1__Norovirus__AGS08113
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucaccaaucagaacacaaaauucacuccaguggguguuauccaggauggcuccaccacacccaggaaugagccgcaacaguggguguugccuagcuacucggggcggaacacccauaauguacaccucgccccagcagucgcccccacuuuuccuggagaacagcuguuauucuuucguucuacgaugcccggcuguuccgguuauccaaacauggaccuggauugccuccuuccucaggagugggugcaauacuucuaucaggaagcugcgcccgcacagucagacguugcccuguugcgcuuugugaauccagauacagggagaguccuauucgaguguaagcugcacaaaaguggcuacgugaccguagcucauacuggacagcacgaccucgugaucccgccuaacggcuauuuuagguucgauagcuggguuaaccaauucuacacccuggcccccauggggaauggagcaggucggcgacgcgcccuuuga

SEQ ID NO: 18372 - RNA, 1623 nt, Artificial Sequence; identical to SEQ ID NO: 18309
  derived and/or modified sequence opt3 from VP1__Norovirus__AGS08114

SEQ ID NO: 18373 - RNA, 1623 nt, Artificial Sequence; identical to SEQ ID NO: 17854
  derived and/or modified sequence opt3 from VP1__Norovirus__AGS08115

SEQ ID NO: 18374 - RNA, 1623 nt, Artificial Sequence; identical to SEQ ID NO: 18300
  derived and/or modified sequence opt3 from VP1__Norovirus__AGS08116

SEQ ID NO: 18375 - RNA, 1623 nt, Artificial Sequence
  derived and/or modified sequence opt3 from VP1__Norovirus__AGS08117
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggaaugcuuacacagaccacucgcacagacggcagcacccgaggccacaaggcuacgguguacaccgggagugccgauuuuucuccuaagcugggaagaguccaauucgcuacagacacugauaaugacuuugugaccaaucagaacacaaaauucacuccagucggugugauccaggauggcuccaccacacccaggaaugagccgcaacaguggguuuugccuagcuacucggggcggaacacccauaaugugcaccucgccccagcaguagcccccacuuuuccuggagaacagcuguuauucuuucguucuacgaugcccggcuguuccgguuauccaaacauggaccuggauugccuccuuccucaggaguggguccaauacuucuaucaggaagcugcgcccgcacagucagacguggcccuguugcgcuuuguuaauccagauacagggagagugcuauucgaguguaagcugcacaaaaguggcuacgucaccguggcucauacuggacagcacgaccucguaaucccgccuaacggcuauuuuagguucgauagcugggugaaccaauucuacacccuggcccccauggggaauggaacaggucggcgacgcgcacuuuga

SEQ ID NO: 18376 - RNA, 1623 nt, Artificial Sequence; identical to SEQ ID NO: 18309
  derived and/or modified sequence opt3 from VP1__Norovirus__AGS08119

SEQ ID NO: 18377 - RNA, 1623 nt, Artificial Sequence; identical to SEQ ID NO: 18355
  derived and/or modified sequence opt3 from VP1__Norovirus__AGS08120

SEQ ID NO: 18378 - RNA, 1623 nt, Artificial Sequence; identical to SEQ ID NO: 18309
  derived and/or modified sequence opt3 from VP1__Norovirus__AGS08121

SEQ ID NO: 18379 - RNA, 1623 nt, Artificial Sequence
  derived and/or modified sequence opt3 from VP1__Norovirus__AGS08122
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugucaccaaucagaacacaaaauucacuccaguggguguuauccaggauggcaauaccacacccaggaacgagccgcaacaguggguguugccuuccuacagcgggcggaauacccauaacguacaccucgccccagcagucgcccccacuuuuccuggagaacagcuguuauucuuucguucgacgaugcccggcuguucugguuauccaaauauggaccuggauugccuccuuccucaggagugggugcaauacuucuaucaggaagcugcgcccgcacaguccgacguugcccuguugcgcuuugugaacccagauacagggagaguccuauucgaguguaagcugcacaaaccgggcuacgugaccguagcucauacuggacagcacgaccucgugaucccucccaacggcuauuuuagguucgauucauggguuaaucaauucuacacccuggccccaauggggaacggaacaggucggcgacgcgcacuuuga

SEQ ID NO: 18380 - RNA, 1623 nt, Artificial Sequence
  derived and/or modified sequence opt3 from VP1__Norovirus__AGS08124
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccggugcguucguugugcagccacagaacggcagauguacuaccgauggggucuugcugggaacaacucaacuaucaccggugaauauaugcaccuuuaggggcgacguaacacauauuagugguagccggaacuacaccaugaaucucgccucucagaacuggaacuccuaugaucccacggaggaaaucccugcaccacuggggacucccgacuucguuggaaagauucagggcgugcuuacacagaccacucgcacagacggcucaacccgagggcacaaggcuacggucuacaccggaagcgccgauuuuaguccuaagcuggguagagugcaauucgcuacagacacugauucugacuuugucaccaaucagaauacaaaauucacuccagugggcguuauccaggauggguccaccacacccaggaacgagccgcaacaguggguguugccuagcuacucgggacggucuacccauaauguacaccucgccccagcagucgcccccacuuuuccuggcgaacagcuguuauucuuucguuccacgaugcccgguuguucaggguauccaaacauggaccuggauugccuccuuccucaggagugggugcaauacuucuaucaggaagcugcgcccgcacagagugacguugcccuguugcgcuuugugaauccagauacaggcagaguccuauucgaguguaagcugcacaaaagcggauacgugaccguagcucauacuggccagcacgaccucgugaucccgccuaacggguauuuuagguucgauuccuggguuaaucaauucuacacccuggcccccaugggaaacgguacaggccggcgacgcgcacuuuga

SEQ ID NO: 18381 - RNA, 1623 nt, Artificial Sequence
  derived and/or modified sequence opt3 from VP1__Norovirus__AGS08125
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcuguguuugccccuaagcugggaagaguucaauucgagacagauacugaccaugauuuugaagcaaaccagaauaccaaauucacaccaguggguguaauccaggacggcaguacuacccacaggaacgagccccaacagugggucuugccgucuuacuccgggcggaauacaccuaacgugcaccucgccccagcuguugcgcccaccuuuccuggagaacagcuguuauucuuucguagcacuaugcccggcuguucggguuauccaaauauggaucuggacugccuccuuccucaggagugggugcaauacuucuaucaggaggcagcccccgcucagucugaugucgcccuguugcgcuuugugaacccagacacggggagaguacuauucgaauguaagcugcauaaauccggcuacgugacaguugcacacaccggacagcaugaucucgucauuccgccuaauggcuauuuuagguucgacucaugggugaaccaauucuacacucuggcccccauggggaacggaaccggucggcgacgcgcucuuuga

SEQ ID NO: 18382 - RNA, 1623 nt, Artificial Sequence; identical to SEQ ID NO: 18319
  derived and/or modified sequence opt3 from VP1__Norovirus__AGS08126

SEQ ID NO: 18383 - RNA, 1623 nt, Artificial Sequence; identical to SEQ ID NO: 17854
  derived and/or modified sequence opt3 from VP1__Norovirus__AGS08127

SEQ ID NO: 18384 - RNA, 1623 nt, Artificial Sequence
  derived and/or modified sequence opt3 from VP1__Norovirus__AGS08128
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacagacggcucaacccgaggccacaaggcuacggucuacaccgggagcgccgauuuuaguccaaagcugggaagagugcaauucgcuacagacacugauaaugacuuugucaccaaucagaacacaaaauucacucccguggguguuauccaggauggcucuaccacaccgaggaaugagccucaacaguggguguugccauccuacagcgggcggaacacccauaauguacaccucgcccccgcagucgccccuacuuuucccggagaacagcuguuauucuuucguucgacgaugccaggcuguucugguuauccuaacauggaccuggauugccuccuuccccaggagugggugcaauacuucuaucaggaagcugcgccagcacaguccgacguugcccuguugcgcuuugugaauccggauacagggagaguccuauucgaguguaagcugcacaaaucaggcuacgugaccguagcucauacuggacagcacgaccucgugaucccucccaacggcuauuuuagguucgauaguuggguuaaccaauucuacacccuggccccaauggggaauggaacaggucggcgacgcgcacuuuga

SEQ ID NO: 18385 - RNA, 1623 nt, Artificial Sequence
  derived and/or modified sequence opt3 from VP1__Norovirus__AGS08129
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucacaacuacaccaugaaucucgccucccagaacuggaacucauaugaucccacggaggaaaucccugcaccacuggguacucccgacuucguugggaagauucagggaaugcuuacacagaccacucggacagacggcagcacccgcggccauaaggcuacgguguacaccgggagugucgauuuuucuccuaagcugggacgagugcaauucacaacugacaccgauaaugacuuugagacaaaucagaacacuaaauucaccccagucggugugauccaggauggcuccacaacccacagaaaugaaccccaacaguggguuuugccgagcuacucggggaggaacacucacaaugugcaucucgccccugcuguagccccaacguuucccggagagcagcuguuauucuuucggucuacaaugccuggcuguuccgguuaucccaacauggaccuggauugccuccuuccacaggaauggguccaauacuucuaucaggaggcagccccugcucagucagacguggcgcuguugcguuuuguuaaucccgauaccgggcgcgugcuauucgaguguaagcugcacaaaaguggcuacgucacuguggcacauaccggacagcacgaccucguaaucccaccgaacggcuauuuuagauucgauagcugggugaaccaauucuacacacuggccccuauggggaauggaaccgguaggcggcgagcucuuuga

SEQ ID NO: 18386 - RNA, 1623 nt, Artificial Sequence
  derived and/or modified sequence opt3 from VP1__Norovirus__AGS08130
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcgcugacggcagcacacgaggccacaaggccaccgucuacacggggagugcugauuuuucuccuaagcugggaagagugcaauucgccaccgacacagauaaugacuuugucgcaaaucagaacacuaaauucaccccaguggguguuauccaggauggcuccacaacucccaggaaugagccgcaacaguggguguugccuagcuacucggggcggaacacccauaauguacaccucgccccagcugucgcgcccacauuuccuggagaacagcuguuauucuuucguucuaccaugcccggcuguuccgguuauccaaacauggaccuggauugccuccuuccucaggagugggugcaauacuucuaucaggaagcagcccccgcucagucagacguugcccuguugcgcuuugugaauccagauacugggagaguccuauucgaguguaagcugcacaaaaguggcuacgugacgguagcacauacaggacagcacgaccucgugaucccgccuaacggcuauuuuagguucgauagcuggguuaaccaauucuacacccuggcccccauggggaauggaacuggucggcgacgcgcucuuuga

SEQ ID NO: 18387 - RNA, 1623 nt, Artificial Sequence
  derived and/or modified sequence opt3 from VP1__Norovirus__AGS08131
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggaaacgugacccauaucacaggcagccggaauuacaccaugaaccucgcaucucagaauuggaacaauuaugaccccacggaggaaauaccugcuccacuggguacucccgauuucgucgggaagauucagggagugcuuacacagaccacucgcacagacggcuccacccgaggccacaaggccacggucuacaucgggucagcugacuuugccccuaagcugggaagagugcaauucgagaccgauacagaccaugauuuugaagcaaaccagaauacuaaauucaccccaguuggugugauucaggacggcgggacaacucacaggaacgagccccaacaguggguauugccgagcuacaguggacggaauacccacaacguccaucucgccccugcuguggcgccaacauuucccggcgaacagcuguuauucuuucguucuaccaugccugguuguuccggguaucccaauauggaucuggacugccuccuuccacaggaguggguucaauacuucuaucaggaggcagccccugcucagagcgauguggcccuguugcgcuuugucaaccccgacacuggcagagugcuauucgaauguaagcugcacaaaucgggauacguaacgguggcacauacaggccagcacgaucucguuaucccaccgaacggguauuuuagguucgacucuugggucaaucaauucuacacccuggccccuaugggaaacgguacuggccggcgacgcgcuguguga

SEQ ID NO: 18388 - RNA, 1623 nt, Artificial Sequence
  derived and/or modified sequence opt3 from VP1__Norovirus__AGS08132
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucacaacuacaccaugaaucucgccucccagaacuggaacucauaugaucccacggaggaaaucccugcaccacuggguacucccgacuucguugggaagauucagggagugcuuacacagaccacucggacagacggcagcacccgcggccauaaggcuacggucuacaccgggagugccgauuuuucuccuaagcugggacgagugcaauucgcuacagacacugauaaugacuuugagaccaaucagaacacaaaauucacuccagucggugugauccaggauggcgggaccacacacagaaaugaaccccaacaguggguuuugccguccuacagcggaaggaacauccacaaugugcaucucgccccugcaguagccccaaccuuucccggcgagcagcuguuauucuuucggucgacuaugccugguuguucuggguaucccaacauggaccuggauugccuccuuccacaggaauggguccaauacuucuaucaggaggcugcgccugcacaguccgacguggcccuguugcguuuuguuaaucccgauacgggccgcgugcuauucgaguguaagcugcacaaaucaggauacgucacaguggcucauaccggccagcacgaccucguaauuccaccgaacggguauuuuagauucgauaguugggugaaccaauucuacacucuggccccuaugggaaaugguaccggcaggcggcgagcacuuuga

SEQ ID NO: 18389 - RNA, 1623 nt, Artificial Sequence
  derived and/or modified sequence opt3 from VP1__Norovirus__AGS08133
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaucuuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaacucccgcuuuccaaucccccuggagaaacuuuucacgggaccuucaagugcguucguugugcagccacagaaugguagauguacuaccgauggcgucuugcuggggacaacucaacuaagcccggugaacauaugcaccuuuaggggagacguaacacauauuucuggcucccggaauuacaccaugaaccucgccucacagaauuggaacagcuaugaucccacggaggaaaucccugcaccacuggguacucccgacuucguugggaagauucagggagugcuuacacagaccacucgcacagacggcaguacccgaggccacaaggcuacggucuacaccgggucugccgauuuuuccccuaagcugggaagagugcaauucgcuacagacacugauaaugacuuugucaccaaccagaauacaaaauucacuccaguggguguuauccaggauggcagcaccacacccaggaacgagccgcaacaguggguguugccuucguacucugggcggaauacccauaacguacaccucgccccagcagucgcccccacuuuuccuggagaacagcuguuauucuuucguuccacgaugcccggcuguucagguuauccaaauauggaccuggauugccuccuuccucaggagugggugcaauacuucuaucaggaagcugcgcccgcacagagugacguugcccuguugcgcuuugugaacccagauacagggagaguccuauucgaguguaagcugcacaaaagcggcuacgugaccguagcucauacuggacagcacgaccucgugaucccgccuaauggcuauuuuagguucgauuccuggguuaaccaauucuacacccuggcccccauggggaacggaacaggucggcgacgcgcacuuuga

SEQ ID NO: 18390 - RNA, 1623 nt, Artificial Sequence
  derived and/or modified sequence opt3 from VP1__Norovirus__AGS08134
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaaugugugcaccuuuaggggagacguaacacauauuccgggcucucacaacuacaccaugaaucucgccucccagaacuggaacucauaugaucccacggaggaaaucccugcaccacuggguacucccgacuucguugggaagauucagggagugcuuacacagaccacuagcacaaauggcaguacccggggccauaaggcuacggucuacaccgggucugccgacuuuuccccuaagcugggacgcgugcaauucgcuacagauacuaauaacgacuuugagaccaaucagaacacaaaauucacuccagucggugugauccaggauggcagcaccacaccccgaaaugaaccgcaacaguggguuuugccuucguacucugggagaaacauccacaaugugcaccucgccccagcaguagcccccaccuuuccuggagagcagcuguuauucuuuagguccacuaugcccggcuguucagguuauccaaacauggaccuggauugccuccuuccucaggaauggguccaauacuucuaucaggaggcugcgcccgcacagagugacguggcccuguugcgguuuguuaacccagauacggggcgugugcuauucgaguguaagcugcauaaaagcggcuacgucacaguggcucacaccggacagcaugaccucguaauuccgccuaauggcuauuuucgcuucgauuccugggugaaccaauucuacacucuggcccccauggggaauggaaccgguagaaggcgggcacuuuga

SEQ ID NO: 18391 - RNA, 1623 nt, Artificial Sequence
  derived and/or modified sequence opt3 from VP1__Norovirus__AGS08135
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucgugcuagcgggaaacgcauuuacugccggcaaaauuaucuucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccguguuaacaguugaggaaaugaccaauagccgcuuuccaauuccccuggagaaacuuuucacgggaccuuccucagcguucgugguccagccacagaacgguagauguacuaccgauggcguguugcuggggacaacucaacuaaguccgguaaauaucugcaccuuuaggggagacguuacacauauaagcggcucucggaacuacaccaugaaucucgccucccagaacuggaacucauaugaucccacggaggaaauuccugcaccacuggguacucccgacuucguggggaagauccagggaguccuuacacagaccacucgcacagacggcagcacccgaggccacaaggcuacgguguacaccgggagugccgauuuuucuccuaagcugggaagaguccaauucgcuacagacacugauaaugacuuugugaccaaucagaacacaaaauucacuccaguuggugugauucaggauggcuccaccacacccaggaaugagccgcaacaguggguauugccuagcuacucggggcggaacacccauaauguccaccucgccccagcaguggcccccacuuuuccuggagaacagcuguuauucuuucguucuacgaugcccggcuguuccgguuauccaaacauggaccuggauugccuccuuccucaggaguggguucaauacuucuaucaggaagcugcgcccgcacagucagacguggcccuguugcgcuuugucaauccagauacagggagagugcuauucgaguguaagcugcacaaaaguggcuacguaaccguggcucauacuggacagcacgaccucguuaucccgccuaacggcuauuuuagguucgauagcugggucaaccaauucuacacccuggcccccauggggaauggaacaggucggcgacgcgcacuuuga

SEQ ID NO: 18392 - RNA, 1623 nt, Artificial Sequence; identical to SEQ ID NO: 18309
  derived and/or modified sequence opt3 from VP1__Norovirus__AGS08136

SEQ ID NO: 18393 - RNA, 1623 nt, Artificial Sequence
  derived and/or modified sequence opt3 from VP1__Norovirus__AGS08137
augaagauggccagcuccgacgcuaaccccucugauggcucaagugcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuaccguuagcccaaggaaugcacccggggagauccuuugguccgccccucugggaccagauuugaaccccuacuuaucucaccuggcucggauguauaauggcuacgccgguggguucgaagugcaggucauucuagcgggaaacgcauuuacagccggcaaaaucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccagagcaaugacccaaccauuaaguugaucgcaaugcucuauacaccccugcgugcuaacaacgccggggaugacguguucacugucaguugcagaguucugaccaggccguccccugauuuugacuucauuuuucucgugcccccaacaguagaaucucggaccaaaccuuucagcgugcccgucuuaacuguggaggaaaugacaaauucccgcuuuccaaucccccuggagaaacuuuucaccggaccuucaagugcguucguugugcagccacagaacgguagauguacgacugauggcgucuugcuggggaccacacaacuaagcccggugaauauaugcacuuuuaggggagacguaacccauauuucuggcucccggaacuacacaaugaaucucgccucacagaacuggaauagcuaugaucccaccgaggaaaucccugcaccacuggguacgcccgacuucguugggaagauucagggagugcuuacucagacaacccgcacugacggcaguacacgaggccacaaggcuaccgucuacacggggucugccgauuuuuccccuaagcugggaagagugcaauucgcuaccgacacagauaacgacuuugucacuaaucagaacaccaaauucacaccaguggguguuauccaggauggcagcacuacccccaggaaugagccgcaacaguggguguugccuucguacucugggcggaacacacauaauguacaccucgccccagcagucgcccccaccuuuccuggagaacagcuguuauucuuucguuccacuaugcccggcuguucagguuauccaaacauggaccuggauugccuccuuccucaggagugggugcaauacuucuaucaggaagcugcgcccgcacagagugacguugcccuguugcgcuuugugaauccagauacggggagaguccuauucgaguguaagcugcacaaaagcggcuacgugacaguagcucauaccggacagcacgaccucgugaucccgccuaacggcuauuuuagguucgauuccuggguuaaccaauucuacacucuggcccccauggggaauggaaccggucggaagcgagcacuuuga

SEQ ID NO: 18394 - RNA, 1623 nt, Artificial Sequence; identical to SEQ ID NO: 18330
  derived and/or modified sequence opt3 from VP1__Norovirus__AGS08138

SEQ ID NO: 18395 - RNA, 1623 nt, Artificial Sequence
  derived and/or modified sequence opt3 from VP1__Norovirus__AGS08139
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaucccacuggagaaacuuuucaccggacccucaagugccuucgucgugcagccucagaacgguagauguacgacugauggcguauugcuggggaccacacaacuaagcccaguuaauauuugcacuuuuaggggagacgugacccauaucacaggcucucggaacuacaccaugaaucucgcaucccagaacuggaauaacuaugauccgacggaggaaauacccgcuccucuggguacuccagacuucgucgggaagauucagggaaugcuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccuguggguguuauccaggauggcaguacuacccacaggaaugagccacaacaguggguguugcccucuuacuccgggcggaacacacacaauguacaucucgccccggcugucgcgccuaccuuuccaggagaacagcuguuauucuuucguagcacuaugcccggcuguucggguuauccuaacauggaccuggauugccuccuuccccaggagugggugcaauacuucuaucaggaggcagccccagcucagucugacguugcccuguugcgcuuugugaauccugauacggggagaguccuauucgaauguaagcugcacaaauccggcuacgugacaguagcacauaccggacagcacgaccucgugauucccccaaacggcuauuuuagguucgauucauggguuaaccaauucuacacucuggccccgauggggaauggaaccggucggcgacgcgucguguga

SEQ ID NO: 18396 - RNA, 1623 nt, Artificial Sequence
  derived and/or modified sequence opt3 from VP1__Norovirus__AGS08140
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccugugggugucauccaggauggcgggacuacccacaggaaugagccacaacaguggguguugcccaguuacucuggacggaacacacacaauguucaucucgccccggcuguggcgccuaccuuuccaggcgaacagcuguuauucuuucguuccacuaugcccgguuguagcggguauccuaacauggaccuggauugccuccuuccccaggaguggguacaauacuucuaucaggaggcagccccagcucagucggacgucgcccuguugcgcuuugugaauccugauacgggcagaguucuauucgaauguaagcugcacaaaucuggauacgugacagucgcacauaccggccagcacgaccucgugauucccccaaacggguauuuuagguucgauuccuggguaaaccaauucuacacucuggccccgaugggaaaugguaccggccggcgacgcgugguuuga

SEQ ID NO: 18397 - RNA, 1623 nt, Artificial Sequence
  derived and/or modified sequence opt3 from VP1__Norovirus__AGS08141
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacugggugcccccgacuucgucgggaagauucagggaaugcuuacucagacaacccgcacugacggcuccacacgaggccacaaggcuaccguguacacggggucagccgauuuugcaccuaagcugggaagaguccaauucgagaccgacacagaucaugacuuugaagccaaucagaacacuaaauucaccccaguggguguuauccaggauggcagcacaacucacaggaaugagccccaacaguggguguugccgaguuacucugggcggaacacccacaauguacaucucgcuccugcggucgcaccaacauuucccggagaacagcuguuauucuuucguuccaccaugccuggcuguagcgguuaucccaacauggaccuggauugccuccuuccacaggagugggugcaauacuucuaucaggaggccgcuccugcccagucggacguugcacuguugcgcuuugugaaucccgauacugggagaguccuauucgaauguaagcugcacaaaucuggcuacgugacgguagcccauacaggacagcacgaccucgugauuccaccgaacggcuauuuuagguucgauuccuggguuaaccaauucuacacccuggcuccuauggggaauggaacuggucggcgacgcgucguguga

SEQ ID NO: 18398 - RNA, 1623 nt, Artificial Sequence
  derived and/or modified sequence opt3 from VP1__Norovirus__AGS08142
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccgggccaaaccuuucucugugcccguuuuaaccguggaggaaaugacuaauagccgcuuuccaaucccccuggagaaacuuuucacaggaccuuccucagcauucgucgugcagccacagaacgguagauguaccacggauggcguauugcuggggacuacccaacuaaguccgguuaauauuugcacauuuaggggagacgugacucauaucaccggcagccggaacuacacaaugaaucucgcuucucagaacugguccaauuaugaucccaccgaggaaauaccugccccacuggguacgcccgacuucgucgggaagauucagggagugcuuacucagacaacccgcacugacggcucaacacgaggccacaaggcuaccgucuacacggggagcgccgauuuugcaccuaagcugggaagagugcaauucgagaccgacacagaucaugacuuugaagccaaccagaauacuaaauucaccccaguuggugugauccaggauggcaguacaacucacaggaacgagccccaacaguggguauugccgucuuacuccgggcggaauaccccuaacguccaccucgcuccagcgguggcacccacauuuccuggagaacagcuguuauucuuucguagcaccaugcccggcuguucggguuauccaaauauggaccuggauugccuccuuccucaggaguggguucaauacuucuaucaggaggccgcucccgcccagucugacguggcacuguugcgcuuugucaacccagauacugggagagugcuauucgaauguaagcugcauaaauccggcuacguaacgguggcccacacaggacagcaugaccucguuauuccgccuaauggcuauuuuagguucgauucaugggucaaccaauucuacacccuggcucccauggggaacggaacuggucggcgacgcgccccauga

SEQ ID NO: 18399 - RNA, 1623 nt, Artificial Sequence; identical to SEQ ID NO: 17662
  derived and/or modified sequence opt3 from VP1__Norovirus__AGS08143

SEQ ID NO: 18400 - RNA, 1623 nt, Artificial Sequence
  derived and/or modified sequence opt3 from VP1__Norovirus__AGS08144
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggaauauccauaacgugcaccucgcccccgcaguagccccuaccuuucccggagagcagcuguuauucuuucguucgacuaugccaggcuguucugguuauccuaauauggaucuggacugccuccuuccccaggaauggguccaauacuucuaucaggaggcugcgccagcacaguccgauguggcccuguugcgcuuuguuaacccggacacggggagagugcuauucgaguguaagcugcacaaaccuggcuacgucacaguggcucauaccggacagcacgaucucguaauucccccaaacggcuauuuuagguucgacucaugggugaaucaauucuacacucuggcccccauggggaacggaaccggucggcgacgcgcacuuuga

SEQ ID NO: 18401 - RNA, 1623 nt, Artificial Sequence
  derived and/or modified sequence opt3 from VP1__Norovirus__AGS08145
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucccgggcucucacaacuacaccaugaaucucgccucccagaacuggaacucauaugaucccacggaggaaacuccugcaccacuggguacacccgacuucguagggaagauucagggaguucuuacccagacuacaagcaccaauggcaguacgcggggccauaaggcuaccguguacacagggucugccgacuuuuccccuaagcugggacgcguccaauucgcuacugauaccaauaacgacuuugagacaaaucagaacacuaaauucaccccagugggugucauccaggauggcagcacaacuccccgaaaugaaccgcaacaguggguguugccuucguacucugggagaaacauccacaauguucaccucgccccagcaguggcccccaccuuuccuggagagcagcuguuauucuuuagguccacgaugcccggcuguucagguuauccaaacauggaccuggauugccuccuuccucaggaauggguacaauacuucuaucaggaggcugcgcccgcacagagugacgucgcccuguugcgguuugugaacccagauacagggcguguucuauucgaguguaagcugcauaaaagcggcuacgugaccgucgcucacacuggacagcaugaccucgugauuccgccuaauggcuauuuucgcuucgauuccuggguaaaccaauucuacacccuggcccccauggggaauggaacagguagaaggcgggcacuuuga

SEQ ID NO: 18402 - RNA, 1623 nt, Artificial Sequence; identical to SEQ ID NO: 18361
  derived and/or modified sequence opt3 from VP1__Norovirus__AGS08146

SEQ ID NO: 18403 - RNA, 1623 nt, Artificial Sequence; identical to SEQ ID NO: 17702
  derived and/or modified sequence opt3 from VP1__Norovirus__AGS08147

SEQ ID NO: 18404 - RNA, 1623 nt, Artificial Sequence; identical to SEQ ID NO: 18309
  derived and/or modified sequence opt3 from VP1__Norovirus__AGS08148

SEQ ID NO: 18405 - RNA, 1623 nt, Artificial Sequence
  derived and/or modified sequence opt3 from VP1__Norovirus__AGS08149
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggaacgccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucuccgugcccgucuuaacaguggaggaaaugaccaacucucgcuuuccaaucccccuggagaaacuuuucacgggaccuagcuccgcguucguugugcagccacagaaugguaaguguacuaccgauggcgucuugcuggggacaacucaacuaucaccggugaacauaugcaccuuuagaggagacguaacacauauucccggcaguaggaauuacaccaugaaccucgccagccagaauuggaacucuuaugauccuacggaggaaaucccagcaccccuggguacuccugacuucguugggaagauucagggagugcuuacacagaccacucggacaaauggcuccacccgcggccacaaggcuacggucuacaccgggucagccgacuuuagcccaaaacugggacgagugcaauucgcuacagauacugacaacgauuuugagaccaaucagaacacaaaguucacucccgucggugugauccaggacggcaguaccacaccgagaaaugaaccucaacaguggguuuugccaucuuacuccgggaggaacauccauaaugugcaccucgcccccgcaguagccccuaccuuucccggagagcagcuguuauucuuucggagcacuaugccaggcuguucggguuauccuaacauggaucuggacugccuccuuccccaggaauggguccaauacuucuaucaggaggcugcgccagcacagucugauguggcccuguugcguuuuguuaacccggacacggggcgcgugcuauucgaguguaaacugcacaaguccggcuacgucacaguggcucauaccggacagcacgaucucguaauuccucccaauggcuauuuuagauucgacucaugggugaaccaauucuacacucuggccccaauggggaauggaaccgguaggcggcgagcacuuuga

SEQ ID NO: 18406 - RNA, 1623 nt, Artificial Sequence; identical to SEQ ID NO: 18355
  derived and/or modified sequence opt3 from VP1__Norovirus__AGS08150

SEQ ID NO: 18407 - RNA, 1623 nt, Artificial Sequence
  derived and/or modified sequence opt3 from VP1__Norovirus__AGS08152
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccgucuuaacuguggaggaaaugacaaauagccgcuuuccaguuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccacaacuacaccaugaaucucgcaucucagaacuggaacuccuaugaucccacggaggaaauuccugcuccacuggguacucccgacuucguggggaagauccagggaguccuuacacagaccacucgggccaauggcucaacacgcggccauaaggcuaccguguacacggggagcgccgacuuugcaccuaagcugggacgaguccaauucgccaccgauacaaauaacgacuuugaugcuaaucagaacacuaaauucaccccaguggguguuauucaggacggcgauacagcgcacagaaaugagccccaacaguggguguugccgaguuacucugggaggaacucccacaauguacaucucgccccugcagucgcuccaacuuuucccggagaacagcuguuauucuuucggagcaccaugccuggcuguucggguuaucccaacauggaccuggauugccuccuuccacaggagugggugcaauacuucuaucaggaagccgccccugcacagucugacguugcucuguugcguuuugugaaccccgauacagggcgcguccuauucgaguguaagcugcacaaauccggcuacgugaccguagcccauacuggacagcacgaccucgugaucccaccgaauggcuauuuuagauucgauucauggguuaaccaauucuacacgcuggcaccuauggggaauggaacagguaggcggcgagcgcuuuga

SEQ ID NO: 18408 - RNA, 1623 nt, Artificial Sequence
  derived and/or modified sequence opt3 from VP1__Norovirus__AGS08153
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccgucuuaacuguggaggaaaugacaaauagccgcuuuccaguuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccacaacuacaccaugaaucucgcaucucagaacuggaacuccuaugaucccacggaggaaauuccugcuccacuggguacucccgacuucguggggaagauccagggaguccuuacacagaccacucgggccgacggcucaacacgcggccauaaggcuaccguguacacggggagcgccgauuuugcaccuaagcugggacgaguccaauucgccaccgacacaaauaaugauuuugacgcuaaccagaauacuaaauucaccccaguggguguuauucaggauggcgacacagcgcacagaaacgagccccaacaguggguguugccgaguuacucugggaggaacucccacaauguacaucucgccccugcagucgcuccaacuuuucccggagaacagcuguuauucuuucggagcaccaugccuggcuguucggguuaucccaauauggaucuggacugccuccuuccacaggagugggugcaauacuucuaucaggaagccgccccugcacagucugauguugcucuguugcguuuugugaaccccgacacagggcgcguccuauucgaguguaagcugcacaaauccggcuacgugaccguagcccauacuggacagcacgaucucgugaucccaccgaacggcuauuuuagauucgacucauggguuaaucaauucuacacgcuggcaccuauggggaacggaacagguaggcggcgagcgcuuuga

SEQ ID NO: 18409 - RNA, 1623 nt, Artificial Sequence
  derived and/or modified sequence opt3 from VP1__Norovirus__AGS08154
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaaguggaggucauucuagcaggaaacgccuuuacagcuggcaaaaucauuuucgccgcagugccuccaaauuuuccgacugagggccucucucccucgcagguaacgauguucccucauaucauaguugacgugcgccagcuggaaccaguccuuaucccccugccugaugugcgaaacaauuuuuaucacuacaaccaaucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagagucucggaccaaaccauucagcgugccugucuuaacuguggaagagaugacaaauucccgcuuucccaucccacuggagaaacuuuucaccggacccucaagugccuucguugugcagccucagaacgguagauguacgacugauggcgucuugcuggggaccacacagcuaagcccagugaauauaugcacuuuuaggggagacguaacccauauuacaggcucucggaacuacaccaugaaucucgcaucccaaaacuggaauaacuaugauccgacggaagagauccccgcuccucuggguacuccagacuucguugggaagauucagggaacacuuacccagacuacacgcaccgacggcucaacgcgaggccacaaggccaccguguacacagggagcgcugauuuugcccccaagcugggaagaguccaguucgaaacugacaccgaucaugacuuugaggcaaaucaaaacacaaaauucacuccugugggugucauccaggauggcaguaccacacacaggaaugaaccacagcaauggguguugcccucuuacuccgggcggaacacccacaauguucaucucgccccggcuguggcgccuacuuuuccaggagagcagcuguuauucuuucguagcacgaugcccggcuguucggguuauccuaacauggaccuggauugccuccuuccccaggaguggguacaguacuucuaucaagaagcagccccagcucagucugacgucgcccuguugcgcuuugugaauccugauacagggagaguucuauucgaguguaagcugcacaaauccggcuacgugaccgucgcacauacuggacagcacgaccucgugauucccccaaacggcuauuuuagguucgauucauggguaaaccaguucuacacccuggccccgauggggaauggaacaggucggcgacgcgugguuuga

SEQ ID NO: 18410 - RNA, 1623 nt, Artificial Sequence; identical to SEQ ID NO: 18317
  derived and/or modified sequence opt3 from VP1__Norovirus__AGS08157

SEQ ID NO: 18411 - RNA, 1623 nt, Artificial Sequence
  derived and/or modified sequence opt3 from VP1__Norovirus__AGS08158
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggaggcagccccugcucagagcgacguggcccuguugcgcuuugucaaucccgauacgggcagagugcuauucgaauguaagcugcacaaaucgggauacguaacaguggcacauaccggccagcacgaccucguuauuccaccgaacggguauuuuagguucgauucuugggucaaccaauucuacacucuggccccuaugggaaaugguaccggccggcgacgcgugaucuga

SEQ ID NO: 18412 - RNA, 1623 nt, Artificial Sequence; identical to SEQ ID NO: 18321
  derived and/or modified sequence opt3 from VP1__Norovirus__AGS08160

SEQ ID NO: 18413 - RNA, 1623 nt, Artificial Sequence
  derived and/or modified sequence opt3 from VP1__Norovirus__AGS08161
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccugugggugucauccaggauggcaguacuacccacaggaaugagccacaacaguggguguugcccucuuacuccgggcggaacacacacaauguucaucucgccccggcuguggcgccuaccuuuccaggagaacagcuguuauucuuucguagcacuaugcccggcuguucggguuauccuaacauggaccuggauugccuccuuccccaggaguggguacaauacuucuaucaggaggcagccccagcucagucugacgucgcccuguugcgcuuugugaauccugauacggggagaguucuauucgaauguaagcugcacaaauccggcuacgugacagucgcacauaccggacagcacgaccucgugauucccccaaacggcuauuuuagguucgauucauggguaaaccaauucuacacucuggccccgauggggaauggaaccggucggcgacgcgcuguguga

SEQ ID NO: 18414 - RNA, 1623 nt, Artificial Sequence
  derived and/or modified sequence opt3 from VP1__Norovirus__AGS08162
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccugugggugucauccaggauggcaguacuacccacaggaaugagccacaacaguggguguugcccucuuacuccgggcggaacacacacaauguucaucucgccccggcuguggcgccuaccuuuccaggagaacagcuguuauucuuucguagcacuaugcccggcuguucggguuauccuaacauggaccuggauugccuccuuccccaggaguggguacaauacuucuaucaggaggcagccccagcucagucugacgucgcccuguugcgcuuugugaauccugauacggggagaguucuauucgaauguaagcugcacaaauccggcuacgugacagucgcacauaccggacagcacgaccucgugauucccccaaacggcuauuuuagguucgauucauggguaaaccaauucuacacucuggccccgauggggaauggaaccggucggcgacgcgugguuuga

SEQ ID NO: 18415 - RNA, 1623 nt, Artificial Sequence; identical to SEQ ID NO: 18414
  derived and/or modified sequence opt3 from VP1__Norovirus__AGS08163

SEQ ID NO: 18416 - RNA, 1623 nt, Artificial Sequence; identical to SEQ ID NO: 18319
  derived and/or modified sequence opt3 from VP1__Norovirus__AGS08164

SEQ ID NO: 18417 - RNA, 1623 nt, Artificial Sequence
  derived and/or modified sequence opt3 from VP1__Norovirus__AGS08165
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaaguggaggucauucuagcaggaaacgccuuuacagcuggcaaaaucauuuucgccgcagugccuccaaauuuuccgacugagggccucucucccucgcagguaacgauguucccucauaucauaguugacgugcgccagcuggaaccaguccuuaucccccugccugaugugcgaaacaauuuuuaucacuacaaccaaucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagagucucggaccaaaccauucagcgugccugucuuaacuguggaagagaugacaaauucccgcuuucccaucccacuggagaaacuuuucaccggacccucaagugccuucguugugcagccucagaacgguagauguacgacugauggcgucuugcuggggaccacacagcuaagcccagugaauauaugcacuuuuaggggagacguaacccauauuacaggcucucggaacuacaccaugaaucucgcaucccaaaacuggaauaacuaugauccgacggaagagauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaguucgaaacagacacugaucaugacuuugaggcaaaucaaaacaccaaauucacaccugugggugucauccaggauggcaguacuacccacaggaaugaaccacagcaauggguguugcccucuuacuccgggcggaacacacacaauguucaucucgccccggcuguggcgccuaccuuuccaggagagcagcuguuauucuuucguagcacuaugcccggcuguucggguuauccuaacauggaccuggauugccuccuuccccaggaguggguacaguacuucuaucaagaagcagccccagcucagucugacgucgcccuguugcgcuuugugaauccugauacggggagaguucuauucgaguguaagcugcacaaauccggcuacgugacagucgcacauaccggacagcacgaccucgugauucccccaaacggcuauuuuagguucgauucauggguaaaccaguucuacacucuggccccgauggggaauggaaccggucggcgacgcgugguuuga

SEQ ID NO: 18418 - RNA, 1623 nt, Artificial Sequence; identical to SEQ ID NO: 18414
  derived and/or modified sequence opt3 from VP1__Norovirus__AGS08166

SEQ ID NO: 18419 - RNA, 1623 nt, Artificial Sequence
  derived and/or modified sequence opt3 from VP1__Norovirus__AGS08167
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaaacgccuucguugugcagccucagaaugguagauguacgacugauggcgucuugcuggggaccacacaacuaaguccagugaacauaugcacuuuuaggggagacguaacccauauuacaggcagccggaauuacaccaugaaccucgcaucucagaauuggaacaauuaugauccgacggaggaaauccccgcuccucuggguacuccagacuucguugggaagauucagggaaugcuuacacagaccacucgcacagacggcuccacccgaggccacaaggccacgguguacaccgggucagcugauuuugcccccaagcugggaagaguccaauucgagacagacacugaucaugacuuugaagcaaaccagaauaccaaauucacaccugugggugucauccaggauggcagcacuacccacaggaacgagccacaacaguggguguugcccaguuacucugggcggaauacacacaacguucaucucgccccggcuguggcgccuaccuuuccaggagaacagcuguuauucuuucguuccacuaugcccggcuguagcgguuauccuaauauggaccuggauugccuccuuccccaggaguggguacaauacuucuaucaggaggcagccccagcucagucggacgucgcccuguugcgcuuugugaacccugauacggggagaguucuauucgaauguaagcugcacaaaucuggcuacgugacagucgcacauaccggacagcacgaccucgugauucccccaaacggcuauuuuagguucgauuccuggguaaaucaauucuacacucuggccccgauggggaacggaaccggucggcgacgcgugguuuga

SEQ ID NO: 18420 - RNA, 1623 nt, Artificial Sequence; identical to SEQ ID NO: 18417
  derived and/or modified sequence opt3 from VP1__Norovirus__AGS08168

SEQ ID NO: 18421 - RNA, 1623 nt, Artificial Sequence
  derived and/or modified sequence opt3 from VP1__Norovirus__AGS08169
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugauauucgaaacaauuuuuaucacuacaaccagucaaaugacagcaccaucaaguugauugcuaugcucuauacaccacugcgugccaacaacgcgggggaugacguguucacugugaguugcagaguccugaccaggcccuccccggauuuugacuucaucuuucucguuccucccacaguggaaucucggaccaaaccauucagcguaccuguguuaacugucgaggaaaugacaaauucccgcuuucccauaccacuggagaaacuuuucaccggacccucaagugccuucgugguucagccucagaacgguagauguacgacugauggcguguugcuggggaccacacaacuaagcccagucaauauuugcacuuuuaggggagacgugacccauaucacaggcucucggaacuacaccaugaaucucgcaucccagaacuggaauaacuaugauccgacggaggaaauucccgcuccucuggguacuccagacuucguagggaagauccagggaguucuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccugugggugucauccaggauggcaguacuacccacaggaaugagccacaacaguggguguugcccucuuacuccgggcggaacacacacaauguucaucucgccccggcuguggcgccuaccuuuccaggagaacagcuguuauucuuucguagcacuaugcccggcuguucggguuauccuaacauggaccuggauugccuccuuccccaggaguggguacaauacuucuaucaggaggcagccccagcucagucugacgucgcccuguugcgcuuugugaauccugauacggggagaguucuauucgaauguaagcugcacaaauccggcuacgugacagucgcacauaccggacagcacgaccucgugauucccccaaacggcuauuuuagguucgauucauggguaaaccaauucuacacucuggccccgauggggaauggaaccggucggcgacgcgugguuuga

SEQ ID NO: 18422 - RNA, 1623 nt, Artificial Sequence; identical to SEQ ID NO: 18414
  derived and/or modified sequence opt3 from VP1__Norovirus__AGS08170

SEQ ID NO: 18423 - RNA, 1623 nt, Artificial Sequence
  derived and/or modified sequence opt3 from VP1__Norovirus__AGS08171
augaagauggccagcuccgacgcuaaccccucugauggcucagcagccaaucuggugccugaggucaacaaugaaguuauggcgcucgacccagugguaggggcugccaucgcagccccgguggcuggacagcaaaacgucaucgaucccuggauaagaaauaacuucgugcaggcaccugguggcgaguuuaccguuaguccaaggaaugcccccggggaaauccuuuggagcgcuccucugggaccagacuugaaccccuacuuaucccaccuggcccggauguauaauggcuacgcggguggguucgaggugcaggucauucuagcaggaaacgccuuuacagcuggcaaaaucauuuucgccgcagugccuccaaauuuuccgacugaaggccucucucccucgcagguaacgauguucccucauaucauaguugaugugcgccaacuggagccaguccuuaucccccugccugacgugcgaaacaauuuuuaucacuacaaccagucaaaugauagcaccauuaaguugaucgcuaugcucuauacaccacugcgugccaacaacgcgggggacgauguguucacugucaguugcagaguucugaccaggcccuccccggacuuugauuucauuuuucucgugccucccacaguagagucucggaccaaaccauucagcgugccugucuuaacuguggaagagaugacaaauucccgcuuucccaucccacuggaaaaacuuuucaccggacccucaagugccuucguugugcagccucagaacgguagauguacgacugacggcgucuugcuggggaccacacaacuaagcccagugaauauaugcacuuuuaggggagauguaacccauauuacaggcucucggaacuacaccaugaaucucgcaucccagaacuggaauaacuaugacccgacggaggagauccccgcuccucuggguacuccagacuucguugggaagauucagggaaugcuuacacagaccacucgcacagauggcucaacccgaggccacaaggccacgguguacaccgggagcgcugacuuugcccccaagcugggaagaguccaauucgaaacagauacugaccaugauuuugaggcaaaucagaacaccaaauucacaccugugggugucauccaggacggcaguacuacccacaggaaugaaccacaacaguggguguugcccucuuacuccgggcggaacacacacaauguucaucucgccccggcuguggcgccuaccuuuccaggagagcagcuguuauucuuucguagcacuaugcccggcuguucggguuauccuaacauggaucuggacugccuccuuccccaggaauggguacaauacuucuaucaggaggcagccccagcucagucugaugucgcccuguugcgcuuugugaauccugacacggggagaguucuauucgaguguaagcugcacaaauccggcuacgugacagucgcacauaccggacagcacgaucucgugauucccccaaacggcuauuuuagguucgacucauggguaaaccaauucuacacucuggccccgauggggaauggaaccggucggcgacgcgugguuuga

SEQ ID NO: 18424 - RNA, 1623 nt, Artificial Sequence; identical to SEQ ID NO: 18319
  derived and/or modified sequence opt3 from VP1__Norovirus__AGS08172

SEQ ID NO: 18425 - RNA, 1623 nt, Artificial Sequence; identical to SEQ ID NO: 18417
  derived and/or modified sequence opt3 from VP1__Norovirus__AGS08173

SEQ ID NO: 18426 - RNA, 1623 nt, Artificial Sequence; identical to SEQ ID NO: 18414
  derived and/or modified sequence opt3 from VP1__Norovirus__AGS08174

SEQ ID NO: 18427 - RNA, 1623 nt, Artificial Sequence; identical to SEQ ID NO: 18313
  derived and/or modified sequence opt3 from VP1__Norovirus__AGS08175

SEQ ID NO: 18428 - RNA, 1623 nt, Artificial Sequence; identical to SEQ ID NO: 18414
  derived and/or modified sequence opt3 from VP1__Norovirus__AGS08176

SEQ ID NO: 18429 - RNA, 1623 nt, Artificial Sequence; identical to SEQ ID NO: 18417
  derived and/or modified sequence opt3 from VP1__Norovirus__AGS08177

SEQ ID NO: 18430 - RNA, 1623 nt, Artificial Sequence; identical to SEQ ID NO: 18414
  derived and/or modified sequence opt3 from VP1__Norovirus__AGS08178

SEQ ID NO: 18431 - RNA, 1623 nt, Artificial Sequence; identical to SEQ ID NO: 18414
  derived and/or modified sequence opt3 from VP1__Norovirus__AGS08179

SEQ ID NO: 18432 - RNA, 1623 nt, Artificial Sequence; identical to SEQ ID NO: 18414
  derived and/or modified sequence opt3 from VP1__Norovirus__AGS08180

SEQ ID NO: 18433 - RNA, 1623 nt, Artificial Sequence; identical to SEQ ID NO: 18417
  derived and/or modified sequence opt3 from VP1__Norovirus__AGS08181

SEQ ID NO: 18434 - RNA, 1623 nt, Artificial Sequence; identical to SEQ ID NO: 18417
  derived and/or modified sequence opt3 from VP1__Norovirus__AGS08182

SEQ ID NO: 18435 - RNA, 1647 nt, Artificial Sequence
  derived and/or modified sequence opt3 from VP1__Norovirus__AGT39181
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugguugcgaugcuguacacaccccucagagccaauaacucuggagacgauguguucacugucucguguaggguguuaacccggccuucaccagacuuuagcuucaauuuucuggugcccccgacagucgaaaguaagaccaaaccuuucacucuucccauuuugacaaucuccgagaugucuaacagccgcuuuccaguuccuauagauucccugcauaccucacccacggaaaauauugugguacagugccagaacgguagagugacucuagacggcgagcucauggggaccacacaacugcuuccaagucagaucugugcauucaggggaguccugacucggagcaccucucgcgcuuccgaucaggccgacacagcuacgccccgauuguucaauuauuacuggcacauucagcucgacaaccugaauggcaccccuuaugauccagccgaggacaucccgggucccuuagggacuccugauuuuagaggaaagguguucggcguugcaucacaaaggaacccagacagcacaacccgggcccaugaagcuaaaguggauacuacagcgggccguuuuacccccaagcuggggagucucgagaucucuacggaauccggagacuucgaucagaaucagccuacccgcuuuacaccagucgguauuggcguggacagagaggcagauuuccaacaguggagccuucccgacuacucggggcaguuuacucacaacaugaaucuggccccggcuguagccccuaacuucccaggagaacaguugcuauuuuucaggucucaacugcccuccucaggcggucggaguaaugggauacucgauugccugguuccucaggagugggugcagcacuuuuaccaggagagcgcacccgcccaaacccaggucgcucuugugcgauaugucaacccagacacaggccgcgugcuguucgaagccaaguugcauaaacucggauuuaugacuaucgcaaagaacggcgacuccccuauuaccguucccccaaauggguacuucagauucgagucuugggugaacccguuuuauacacuggcgccuaugggaaccgguaauggcaggcggcgcauccaguga

SEQ ID NO: 18436 - RNA, 1608 nt, Artificial Sequence
  derived and/or modified sequence opt3 from VP1__Norovirus__AGT39191
augaagauggccagcaacgacgcugcacccuccaaugauggcgccgcggggcuggugccugaggucaccaacgaaacaauggcucucgagccaguugccagagcaucuaucgccgcuccgcuuacuggacagaauaacgugauugaccccuggauaacgcugaauuucggucaagcaccuaccggccacuugacauuaucaccacccuacaguccuggggaaguacugcuaaaccucgagcugaggccagaacuuaaucccuaucuggccaacuugagccggauguacaauggauaugcuggcgguguggagguccaggugcuccuggccgggaacgcguuuacugcaggaaaacugguuuucgccgcugugccuccacauuuuccgcucgagaauaucucccccggccagauuaccauguucccucacgucaucauugaugugcgcacauuagaaccaguacugcuucccuugccugacguucgaaacaacuuuuuccauuacaaucagcaaaaugagccacguaugagacugguggccaugcuauauacccccuuaaggucuaacggcucgggggaugacgucuuuacugugucaugccgggugcugacacgcccgagcccugauuucgacuuuaacuaccuuguucccccaaccgucgaaaguaagacgaaaccuuucacucugcccaucuugaccauaggagagcucacaaauuccagauuuccagugcccaucgaugagcuguauacuucuccuaacgaaagccucguagugcagccacagaaugguaggugugcacuggacggcgagcuccaggggaccacacaacuucugccgaccgcuauuugcuccuuccggggacgcaucaaccagaaggucucaggcgaaaaucacguguggaacaugcagauuacgaauaucaacgguacucccuuugauccuacagaggacguuccagcccccuuggggaccccugauuucaguggaaaacuauucggcgugcugagccagcgagaccaugacaaugcguguagaucucacgaugccgucauagcaacuaacuccgcuaaguuuacaccaaagcucggcgccauucaaaucgggaccugggaacaggacgaugugcacauuaaucagcccacgaaauucaccccgguaggacuguuugagucagaggguuucaaccaauggacacuuccuaauuacagcggcgcucugacuuugaacauggggcucgccccacccguugcaccuaccuuucccggagaacagauccuguucuuuaggagucauaucccauuaaagggcgguguggccgacccugucauugauugccugcuaccccaggaguggauacagcaccucuaccaagaaucugcuccaucccagacagacguggcgcugauccgguucacuaauccggauaccgggcguguccuuuuugaggcaaaauugcaucgcagcggcuauauuacaguggccaacaccggaucgagaccuaucguugugcccgcuaacggcuacuucagguuugacucuuggguaaaucaguucuauucccuggccccaauggggacuggaaacggucggcgacgcguccaguga

SEQ ID NO: 18437 - RNA, 1608 nt, Artificial Sequence
  derived and/or modified sequence opt3 from VP1__Norovirus__AGT39194
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggaggucuuguuaaaucuggaacuaggaccugagcucaacccauaccuggcccaccuuagccggauguauaauggcuacgcuggugggguggagguucaggugcuguuggccggaaacgcguucacggcaggcaaacucgucuuugccgcugugcccccucauuucccacuggaaaauaucuccccgggccagauuaccauguuuccccacguaaucauugauguucgcacacuggagccugugcucuuaccacugcccgacguccgaaacaauuucuuucauuauaaccagcaaaacgaaccucguaugagacuuguggccauguuguacacuccacugaggucuaaugggucgggagaugacguguucaccgucucaugccggguucuaacacgccccagcccggauuuugacuucaacuaucucgugccucccaccguagagaguaagacuaaaccauuuacacugccuauccuuaccauaggugagcugacuaauuccagauuccccgugccaaucgaugaauuguacacgucucccaacgagagccucgucgugcagccucagaaugggaggugugcacuggacggcgaauuacagggaaccacacaacugcucccaacugcuauuugcuccuuucggggccgcaucaaccagaagguuucaggugagaaucacguguggaacaugcagauuaccaauaucaacgggacaccguucgaucccaccgaagacgucccugccccacuuggaacgcccgauuucaguggcaaacuguuuggcguguugagccagcgagaccaugacaaugcguguagaucucacgaugccguaauagcaacuaacuccgcuaaguucacaccuaagcuaggggccauucaaaucggaaccugggagcaggacgauguucacauuaaucagccaacuaaauuuacacccgugggucuguucgagucagaaggcuuuaaccaauggacccucccgaauuauagcggggcucugacgcuuaacaugggacuggccccuccagucgcacccaccuucccuggcgagcagaucuuguuuuucaggagucauaucccccucaagggugggguggccgacccagucauugauugccuguuaccucaggaauggauacagcaccuguaccaagagucugcucccucccagacagacguggcgcuaauccgguuuacuaacccagauaccggccguguucucuucgaagcaaaacugcaucgcagcggauacauuacaguggccaauacuggcucgagaccgaucguagucccugcuaacggguauuuuagguucgacucuugggugaaucaguuuuacucccuugcccccaugggaaccgguaacggccggcgacgcguucaguga

SEQ ID NO: 18438 - RNA, 1608 nt, Artificial Sequence
  derived and/or modified sequence opt3 from VP1__Norovirus__AGT39197
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggaggucuuguuaaaucuggaacuaggaccugagcucaacccauaccuggcccaccuuagccggauguauaauggcuacgcuggugggguggagguucaggugcuguuggccggaaacgcguucacggcaggcaaacucgucuuugccgcugugcccccucauuucccacuggaaaauaucuccccgggccagauuaccauguuuccccacguaaucauugauguucgcacacuggagccugugcucuuaccacugcccgacguccgaaacaauuucuuucauuauaaccagcaaaacgaaccucguaugagacuuguggccauguuguacacuccacugaggucuaaugggucgggagaugacguguucaccgucucaugccggguucuaacacgccccagcccggauuuugacuucaacuaucucgugccucccaccguagagaguaagacuaaaccauuuacacugccuauccuuaccauaggugagcugacuaauuccagauuccccgugccaaucgaugaauuguacacgucucccaacgagagccucgucgugcagccucagaaugggaggugugcacuggacggcgaauuacagggaaccacacaacugcucccaacugcuauuugcuccuuucggggccgcaucaaccagaagguuucaggugagaaucacguguggaacaugcaggucaccaauauuaacgggacaccguucgaucccaccgaagacgugccugccccacuuggaacgcccgauuucaguggcaaacuguuuggcguauugagccagcgagaccaugacaaugcguguagaucucacgaugccguuaucgcaacuaacuccgcuaaguucacaccuaagcuaggggccauacaaauuggaaccugggaggagaaugacgugcacaucaaccagccaacuaaauuuacacccgucggucuguucgaaucagagggcuuuaaucaguggacccucccgaacuauagcggggcucugacgcuuaacaugggacuggccccuccaguggcacccaccuucccuggcgaacaaauuuuguuuuucaggagucauaucccccucaaggguggggucgccgauccagugaucgacugccuguuaccucaggaguggauucagcaccuguaccaggaaucugcucccucccaaacagauguugcgcuaauacgguuuacuaauccagacaccggccguguacucuucgaggcaaaacugcaucgcagcggauacaucacaguggccaacacuggcucgagaccgauugucgugccugcuaauggguauuuuagguucgauucuuggguuaaccaguuuuacucccuugcccccaugggaaccgguaauggccggcgacgcgugcaguga

SEQ ID NO: 18439 - RNA, 1608 nt, Artificial Sequence
  derived and/or modified sequence opt3 from VP1__Norovirus__AGT39200
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggaggucuuguuaaaucuggaacuaggaccugagcucaacccauaccuggcccaccuuagccggauguauaauggcuacgcuggugggguggagguucaggugcuguuggccggaaacgcguucacggcaggcaaacucgucuuugccgcugugcccccucauuucccacuggaaaauaucuccccgggccagauuaccauguuuccccacguaaucauugauguucgcacacuggagccugugcucuuaccacugcccgacguccgaaacaauuucuuucauuauaaccagcaaaacgaaccucguaugagacuuguggccauguuguacacuccacugaggucuaaugggucgggagaugacguguucaccgucucaugccggguucuaacacgccccagcccggauuuugacuucaacuaucucgugccucccaccguagagaguaagacuaaaccauuuacacugccuauccuuaccauaggugagcugacuaauuccagauuccccgugccaaucgaugaauuguacacgucucccaacgagagccucgucgugcagccucagaaugggaggugugcacuggacggggaauuacagggaaccacacaacugcucccaacugcuauuugcuccuuucggggccgcaucaaccagaagguuucaggugagaaucacguguggaacaugcagauuaccaauaucaacgggacaccguucggacccaccgaagaugucccugccccacuuggcacgcccgacuucaguggcaaacuguuugggguguugagccagcgagaucaugacaaugcguguagaucucacgacgccguaauagcaacuaacuccgcuaaguucacaccuaagcuaggagccauucaaaucgguaccugggagcaggaugacguucacauuaaucagccaacuaaauuuacacccgugggccuguucgagucagaaggguuuaaccaauggacccucccgaauuauagcggagcucugacgcuuaacaugggccuggccccuccagucgcacccaccuucccuggugagcagaucuuguuuuacaggagucauaucccccucaagggcggcguggccgauccagucauugacugccuguuaccucaggaauggauacagcaccuguaccaagagucugcucccucccagacagauguggcgcuaauccgguucacuaacccagacaccggacguguucucuuugaagcaaaacugcaucgcagcggcuauauuacaguggccaauacugggucgagaccgaucguagucccugcuaacggauacuucagguuugauucuugggugaaucaguucuauucccuugcccccauggguaccggcaacgggcggcgacgcguucaguga

SEQ ID NO: 18440 - RNA, 1608 nt, Artificial Sequence; identical to SEQ ID NO: 17868
  derived and/or modified sequence opt3 from VP1__Norovirus__AGT39203

SEQ ID NO: 18441 - RNA, 1629 nt, Artificial Sequence
  derived and/or modified sequence opt3 from VP1__Norovirus__AGT39206
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacagucccggggagguccuguugaauuuagaacugggaccugagcuaaacccauaccucgcccaccuggcgcggauguauaauggcuacgccggugggauggaggugcagguuaugcuugcaggaaacgcuuucaccgccggcaaacugguguuugcagcugugcccccucauuucccagucgaaaauuugagcccgcagcagaucacaauguuuccccacguaauuaucgauguucgcacucucgagccugugcugcugccacuccccgacguccgaaacaauuucuuucauuauaaccaaaaggaugacccuaaaaugcguauuguggccauguuauacaccccacugagauccaauggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaacucccgcuuccccgugucuauagaucagauguacaccagcccaaacgaggucaucuccgugcagugucagaaugguagaugcacacuugacggcgaacugcaagggacuacccaguugcagguuucaggaauuugugcguuuaagggcgaggugacagcccaccuccaugauaacgaccaccuguauaaugucaccaucacgaacuuaaaugguagucccuucgacccuagcgaagauauuccagcaccgcugggggugcccgacuuccagggaaggguauuuggcguuaucucucaacgggauaagcacaacacuccuggccauaaugagccagcuaaccgcgcccacgacgcugugguccccacauacaccgcccaguacacuccuaaacucgggcagauacaaauuggaacauggcagaccgaugaccuuacggugaaucagccagucaaguucacccccgugggucugaacgauacagaccauuuuaaucaguggguugugccgcgauaugcaggcgccuugaaccuaaauacuaaccuggcuccuuccguagcgccagucuuccccggggaaagacuccuguuuuucaggucauacaucccucuuaaaggaggcuaugguacccccgcaauugauugccuguugccacaagagugggugcagcacuuuuaccaggaggccgcuccuagcaugagugaaguugcccucgugcgguauaucaaucccgacacagggcgugcacuguucgaggccaaguuacaccgcgcuggcuuuaugacugucucuuccaacaccagcgccccagugguagugccggcaaacggauacuucagauuugauucguggguuaaucaguucuauucucuggcgccuaugggcacagggaacggaaggcggcgaauccaauga

SEQ ID NO: 18442 - RNA, 1623 nt, Artificial Sequence
  derived and/or modified sequence opt3 from VP1__Norovirus__AHF45991
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccucuacccaggaguacacgaugaaccucgcaucccagaauuggaacaauuaugaucccacugaagagauuccugcuccacuggggacacccgacuucguaggcaagauccaggguguucuuacccaaacuacacggcgcgacgggucaacccgaggacacaaggccacggugagcaccggcaguguccauuuuacaccuaagcugggcagaauccaguucucuacugauaccuccaacgacuuugaaacagggcagaauacuagguucaccccagugggagucgugcaagaugguagcacaacccaccagaacgagccccagcaguggguuuugccgaauuacucgggccgggacucucacaacgugcaucucgcuccugccguagcaccauccuuucccggggaacaacuguuauucuuucguucaacuaugccuggauguaguggcuaccccaauaugaaccuggauugccuccuuccacaggaguggguccagcacuucuaucaggaggccgcuccugcgcaaagcgacguggcacuguugcgcuuuguuaaucccgauacggguagagugcuauucgaauguaaacugcauaaguccggguacgucacaguggcccacaccggccagcacgaccucguaauuccaccgaacggauauuuuagguucgauucuugggugaaccaguucuacacucuggcuccuaugggcaaugggaccggacggcgacgcgcccuuuga

SEQ ID NO: 18443 - RNA, 1623 nt, Artificial Sequence; identical to SEQ ID NO: 17662
  derived and/or modified sequence opt3 from VP1__Norovirus__AHF45993

SEQ ID NO: 18444 - RNA, 1623 nt, Artificial Sequence; identical to SEQ ID NO: 18319
  derived and/or modified sequence opt3 from VP1__Norovirus__AHF45997

SEQ ID NO: 18445 - RNA, 1623 nt, Artificial Sequence; identical to SEQ ID NO: 18319
  derived and/or modified sequence opt3 from VP1__Norovirus__AHF45999

SEQ ID NO: 18446 - RNA, 1623 nt, Artificial Sequence; identical to SEQ ID NO: 18319
  derived and/or modified sequence opt3 from VP1__Norovirus__AHF46001

SEQ ID NO: 18447 - RNA, 1617 nt, Artificial Sequence
  derived and/or modified sequence opt3 from VP1__Norovirus__AHH44876
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccaucucaccaaggaacgcccccggggagauucuuuggagugcuccucugggaccagauuugaaucccuacuuaagccaccuggcccggauguauaacggcuacgcggguggguucgaaguucaggugguccuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccugucuuaacaguggaggaaaugaccaacucucgcuuucccaucccacuggagaaacuuuucacgggacccagcuccgccuucguugugcagccucagaaugguagauguacuaccgauggcgucuugcuggggacaacucaacuaucagcagugaacauaugcaccuuuaggggagacguaacacauguuagugauaagaccuucgcuaugaaucucgccagcccaaacuggaauaacuacgacccgacggaggacauucccgcuccucugggcacuccagauuuugugggucggauccacgggaugcuuacacagaccacucgccgagacggagccacaagaggccauaaggcaaccgucucuacgggcggggccgauuucacccccaagcugggauccgugagguauauuacagacacuaccgaugacuuggaaguccgggagaauacaaaauuuacuccuaucggugugcuccacucaagcggcgaacaccgugcugagccagaucaguggcgccugcccgaauacagugggagaaacguucauaaugugcacuuagcgccggcaguagccccuaccuucccaggagagcagcugcucuuuuucaggucugcccuucccggcugugguggguacccuaacacagaccuggauugcuugcuaccccaagaguggguccagcauuuuuaucaggaagcugcaccagcccaauccgacguggcucugcuccgguucguuaauccugauaccggccgagugcuguuugaguguaaacuucacaagagcggauacgucacuguggcccacacgggcccccaugaccugguaaucccaccgaacggguauuuccgcuuugacucgugggugaaucaguucuacacauuggcaccuaugggaaacgguaccggcagaaggcgggcgcucuga

SEQ ID NO: 18448 - RNA, 1617 nt, Artificial Sequence
  derived and/or modified sequence opt3 from VP1__Norovirus__AHH44877
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccaucucaccaaggaacgcccccggggagauucuuuggagugcuccucugggaccagauuugaaucccuacuuaagccaccuggcccggauguauaacggcuacgcggguggguucgaaguucaggugguccuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaaggacucaaccauuaaauugaucgcuaugcucuauacaccacugcgugccaacaacgcgggggaugacguguucacugucagcugcagaguucugaccaggcccaguccggauuuugacuucauuuuucucgugccucccacaguagaaucccggaccaagccauucucugugccugucuuaacuguggaggaaaugacaaauagccgcuuucccaucccacuggagaaacuuuucaccggacccuccucagccuucguugugcagccucagaacgguagauguacgacugauggcgucuugcuggggaccacacaacuaagugcagugaauauaugcacuuuuaggggagacguaacccauguugcuggcgauacauucgccaugaaccucgcuagccugaauuggaacaauuacgacccaaccgaggaaacgccggcaccccuugguacuccugacuuuguggggcggauucacggaaugcugacacagaccacucgcucugauggcgccacacgagcccauaaggcuaccgucuccacgggcggggcggacuucaccccaaaguugggaucagugagauauagcacagauaccaguggugaccucgaggucagggaaaacacuaaauuuacacccaucggcgugcugcacucuuccggggagcggcgugcagaaccugagcaguggcgcuuaccagaguacagcggaagaaauguucacaacgugcaucuggcccccgcuguagccccgacuuucccuggcgaacagcuccuguuuuucaggucgaccaugccagguugugggggcuaccccaauauggaucuugacugcuugcuaccucaagaguggguccagcacuuuuaucaggaagcagcccccgcucaaucugauguggcccugcuccgguucguuaacccagacacaggacgagugcuguuugaguguaaacuucauaaguccggcuacgucaccguggcacacacugggccucacgaucugguaauucccccaaauggauauuuccgcuuugacucaugggugaaccaguucuacacguuggcgccgauggguaauggcacagggagaaggcgggcucucuga

SEQ ID NO: 18449 - RNA, 1617 nt, Artificial Sequence
  derived and/or modified sequence opt3 from VP1__Norovirus__AHH44878
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccaucaguccaaggaaugcccccggggagauucuuuggagcgcuccucugggaccagauuugaaccccuacuuaucccaccuggcccggauguauaauggcuacgcggguggguucgaaguucaggugguccuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaggacagcaccauuaaauugaucgcuaugcucuauacaccacugcgugccaauaacgcgggggaugacguguucacugucaguugcagaguucugaccaggcccuccccggauuuugacuucauuuuucucgugccucccacaguagaaucucggaccaagccauucagcgugccugucuuaacuguggaggaaaugacaaacucccgcuuucccaucccacuggagaaacuuuucaccggacccucaagugccuucguugugcagccucagaaugguagauguacgacugauggcgucuugcuggggaccacacaacuaagcgcagugaacauaugcacuuuuaggggagacguaacccauguugcuggcgauacauucgccaugaaucucgcuucucugaacuggaauaacuacgacccaaccgaggaaacgccggcaccccuugguacuccugacuuuguggggcggauucacggaaugcugacacagaccacucgcuccgauggcgccacacgagcccauaaggcuaccgucucaacgggcggggcggacuucaccccaaaguugggaagcgugagauauaguacagauacuucuuccgaccucgaggucagggaaaauaccaaauuuacacccaucggugugcugcacagcucgggcgggcaccgggcagagccugaucaguggcguuuaccagaauacucuggacgcaacguucauaaugugcaccuggcccccgcuguagccccgacuuucccuggcgagcagcuccuguuuuucagauccaccaugccagguugugggggcuaccccaacauggaccuugauugcuugcuaccucaagaguggguccagcauuuuuaucaggaagcagcccccgcucaaucagacguggcccugcucagguucguuaauccagauacaggacgggugcuguuugaguguaaacuucacaagaguggcuacgucaccguggcacacacugggccucaugaccugguaauucccccaaacggauauuuccgauuugauagcugggugaaucaguucuacacguuggcgccgauggguaacggcacagggcgcagaagggcucucuga

SEQ ID NO: 18450 - RNA, 1617 nt, Artificial Sequence
  derived and/or modified sequence opt3 from VP1__Norovirus__AHH44879
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccaucucaccaaggaacgcccccggggagauucuuuggagugcuccucugggaccagauuugaaucccuacuuaagccaccuggcccggauguauaacggcuacgcggguggguucgaaguucaggugguccuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaaggacucaaccauuaaauugaucgcuaugcucuauacaccacugcgugccaacaacgcgggggaugacguguucacugucagcugcagaguucugaccaggcccaguccggauuuugacuucauuuuucucgugccucccacaguagaaucccggaccaagccauucucugugccugucuuaacuguggaggaaaugacaaauagccgcuuucccaucccacuggagaaacuuuucaccggacccuccucagccuucguugugcagccucagaacgguagauguacgacugauggcgucuugcuggggaccacacaacuaagugcagugaauauaugcacuuuuaggggagacguaacccauguugcuggcgauacauucgccaugaaccucgcuagccugaauuggaacaauuacgacccaaccgaggaaacgccggcaccccuugguacuccugacuuuguggggcggauucacggaaugcugacacagaccacucgcucugauggcgccacacgagcccauaaggcuaccgucuccacgggcggggcggacuucaccccaaaguugggaucagugagauauagcacagauaccaguucugaccucgaggucagggaaaacacuaaauuuacacccaucggugugcugcacuccagcggcgggcaccgggcagagccugaucaguggcguuuaccagaauacucgggacgcaauguucauaacgugcaccuggcccccgcuguagccccgacuuucccuggcgagcagcuccuguuuuucagaucuaccaugccagguugugggggcuaccccaauauggaccuugauugcuugcuaccucaagaguggguccagcauuuuuaucaggaagcagcccccgcucaauccgacguggcccugcucagguucguuaacccagauacaggacgggugcuguuugaguguaaacuucacaagucaggcuacgucaccguggcacacacugggccucaugaccugguaauucccccaaauggauauuuccgauuugauaguugggugaaccaguucuacacguuggcgccgauggguaauggcacagggcgcagaagggcucucuga

SEQ ID NO: 18451 - RNA, 1617 nt, Artificial Sequence
  derived and/or modified sequence opt3 from VP1__Norovirus__AHH44880
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccaucucaccaaggaacgcccccggggagauucuuuggagugcuccucugggaccagauuugaaucccuacuuaagccaccuggcccggauguauaacggcuacgcggguggguucgaaguucaggugguccuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaaggacucaaccauuaaauugaucgcuaugcucuauacaccacugcgugccaacaacgcgggggaugacguguucacugucagcugcagaguucugaccaggcccaguccggauuuugacuucauuuuucucgugccucccacaguagaaucccggaccaagccauucucugugccugucuuaacuguggaggaaaugacaaauagccgcuuucccaucccacuggagaaacuuuucaccggacccuccucagccuucguugugcagccucagaacgguagauguacgacugauggcgucuugcuggggaccacacaacuaagugcagugaauauaugcacuuuuaggggagacguaacccauguugcuggcgauacauucgccaugaaccucgcuagccugaauuggaacaauuacgacccaaccgaggaaacgccggcaccccuugguacuccugacuuuguggggcggauucacggaaugcugacacagaccacucgcucugauggcgccacacgagcccauaaggcuaccgucuccacgggcggggcggacuucaccccaaaguugggaucagugagauauagcacagauaccaguucugaccucgaggucagggaaaacacuaaauuuacacccaucggugugcugcacuccagcggcgggcaccgggcagagccugaucaguggcguuuaccagaauacucgggacgcaauguucauaacgugcaccuggcccccgcuguagccccgacuuucccuggcgagcagcuccuguuuuucagaucuaccaugccagguugugggggcuaccccaauauggaccuugauugcuugcuaccucaagaguggguccagcauuuuuaucaggaaacagcacccgcccaauccgacguggcucugcucagguucguuaacccagauaccggacgggugcuguuugaguguaaacuucacaagucaggcuacgucacuguggcccacacggggccucaugaccugguaauucccccaaauggauauuuccgauuugauaguugggugaaccaguucuacacauuggcaccgauggguaauggcaccgggcgcagaagggcgcucuga

SEQ ID NO: 18452 - RNA, 1617 nt, Artificial Sequence
  derived and/or modified sequence opt3 from VP1__Norovirus__AHH44881
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucaucgaccccuggauaagaaacaauuucgugcaggcaccugguggcgaauuuaccaucucaccaaggaacgcccccggggagauucuuuggagugcuccucugggaccagauuugaaucccuacuuaagccaccuggcccggauguauaacggcuacgcggguggguucgaaguucaggugguccuagcaggaaaugccuuuacagcuggcaaagugaucuucgccgcaguaccuccaaacuuuccgacugagggccucucccccucucagguuacgauguucccucauauuaucguggacguccgccaacuggagccagugcuuauaccccugccugaugugcgaaauaacuuuuaucacuacaaucagucgaacgacucaaccaucaaguugauugcuaugcucuauacaccacugcgugccaacaaugcgggggaugacgucuucacuguuagcugcagagugcugaccaggcccaguccggauuuugacuucaucuuucucguaccucccacaguggaaucccggaccaaaccauucucugucccuguguuaacuguugaggaaaugacaaacagccgcuuucccauuccacuggagaaacuuuucaccggacccuccucagccuucgugguccagccucagaaugguagauguacgacugauggcguguugcuggggaccacacaacuaagugcaguaaacaucugcacuuuuaggggagacguuacccauguggcuggcgauacauucgccaugaaucucgcuagccugaacuggaauaacuacgacccaaccgaggaaacgccggcaccccuugguacuccugacuuugucgggcggauacacggaaugcugacacagaccacucgcucugauggcgccacacgagcccauaaggcuaccguguccacgggcggggcggacuucaccccaaaguugggaucagucagauauagcacagauaccaguucugaccucgaggugagggaaaauacuaaguuuacacccauugguguucugcacuccagcggcgggcaccgggcagagccugaucaguggcguuuaccagaauacucgggacgcaacgugcauaauguacaccuggcccccgcugucgccccgacuuucccuggcgagcagcuccuguuuuucagaucuaccaugccagguugugggggcuaccccaacauggaccuugauugcuugcuaccucaagagugggugcagcauuuuuaucaggaagcagcccccgcucaauccgacguugcccugcucagguucgugaauccagauacaggacggguccuguuugaguguaaacuucacaagucaggcuacgugaccguagcacacacugggccucaugaccuggugauucccccaaacggauauuuccgauuugauaguuggguuaaucaguucuacacguuggcgccgauggguaacggcacagggcgcagaagggcucucuga

SEQ ID NO: 18453 - RNA, 1617 nt, Artificial Sequence
  derived and/or modified sequence opt3 from VP1__Norovirus__AHH44884
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccaucucaccaaggaacgcccccggggagauucuuuggagugcuccucugggaccagauuugaaucccuacuuaagccaccuggcccggauguauaacggcuacgcggguggguucgaaguucaggugguccuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaauuaucaaguugauugcuaugcucuauaccccacugcgugccaacaaugcgggggaugacguguucacagucagcugcagaguucugacuaggcccaguccggauuuugacuucaucuuucucgugccucccaccguagaaucccggacaaaaccauucaccgugccugucuuaacuguggaugagaugacaaacucucgcuuucccauaccacuggaaaaacuuuucaccggacccagcuccgccuucguugugcagccucagaaugguagauguacgacugacggcgucuugcuggggaccacacaacuaucagcagugaacauuugcacuuuuaggggagauguaacccauguuagugacaagacauucgcuaugaaucucgccagcccaaacuggaauaacuacgacccgaccgaggagauccccgcuccucugggcacgccagauuuugugggucggauucacgggaugcuuacucagacaacccgccgagacggagccacuagaggccauaaggcaacagucucuaccggcggggccgauuucacgcccaagcugggauccgugagguauaucaccgacacaacugaugacuuggaaguccgggagaauaccaaauuuacaccuaucggugugcuccacucaagcggcgaacaccgugcugagccagaucaguggcgccugcccgaauacagugggagaaacguucauaaugugcacuuagcgccggcaguagccccuacuuucccaggagagcagcugcucuuuuucaggucugcccuucccggcugugguggguacccuaacaccgaccuggauugcuugcuaccccaagaguggguccagcauuuuuaucaggaagcugcaccagcccaauccgacguggcucugcuccgguucguuaauccugauacaggccgagugcuguuugaguguaaacuucacaagagcggauacgucaccguggcccacacuggcccccaugaccugguaauuccaccgaacggguauuuccgcuuugacucgugggugaaucaguucuacacguuggcaccuaugggaaacgguacaggcagaaggcgggcgcucuga

SEQ ID NO: 18454 - RNA, 1620 nt, Artificial Sequence
  derived and/or modified sequence opt3 from VP1__Norovirus__AHH44886
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccggugccuucguugugcagccacagaauggcagauguacgacugacggggucuugcugggaaccacacaacuaucaccggugaacauaugcacuuuuaggggcgaucucacccauuucacagguaccagugaauacgcaaugaaucuggcuagccagaacuggaauaacuaugaccccacggaggaaauuccugccccacuuggggcucccgauuuuguaggaaagauccggggcaugcugacucagacaacccgccgagacggcucuacuagagggcacagggccacauuguccaccggaucagcacauuucacgccuaagcucgguagcauucgguuuaguaccgacacaaauaacgauuucgaggccggccagaauacuaaauuuaccccaguugggguguuccaagaaggagacaaccaccagaaugagccccagcaauggguccugccgaacuacucuggcgcuacagcgcacaaugugcauuuagccccugcagucgcuccagccuuucccggugagcagcuccuguucuuucguuccacuaugccuggguguggcggauaccccaacaugaaucuugauugccuguugccacaggaaugggugcagcacuucuaucaagaggcagccccugcucagagcgacguugcccuacugcgcuuugugaaccccgauaccucgagaguacucuucgaauguaagcugcauaaaucuggcuacgucacaguggcacacaccgggcagcacgaccuuguuaucccaccgaacggauauuucagguuugauuccugggugaaucaguucuacacucuggcgccuauggguaacggcacggggcggcgacgcgcuuuguga

SEQ ID NO: 18455 - RNA, 1620 nt, Artificial Sequence
  derived and/or modified sequence opt3 from VP1__Norovirus__AHH44888
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccggugccuucguugugcagccacagaauggcagauguacgacugacggggucuugcugggaaccacacaacuaucaccggugaacauaugcacuuuuaggggcgaucucacccauuucacagguaccagugaauacgcaaugaaucuggcuagccagaacuggaauaacuaugaccccacggaggaaauuccugccccacuuggggcucccgauuuuguaggaaagauccggggcaugcugacucagacaacccgccgagacggcucuacuagagggcacagggccacauuguccaccggaucagcacauuucacgccuaagcucgguaauauucgguuuagcaccgacacaaacaaugauuucgaggccggccagaacacuaaauuuaccccaguugggguguuccaagaaggagacaaucaccagaacgagccccagcaauggguccugccgaauuacaguggcgcuacagcgcacaacgugcauuuagccccugcagucgcuccagccuuucccggugagcagcuccuguucuuucguucuacuaugccuggguguggcggauaccccaauaugaaccuugauugccuguugccacaggaaugggugcagcacuucuaucaagaggcagccccugcucaguccgacguugcccuacugcgcuuugugaaccccgauaccagcagaguacucuucgaauguaagcugcauaaaucgggcuacgucacaguggcacacaccgggcagcacgaccuuguuaucccaccgaauggauauuucagguuugauucuugggugaaccaguucuacacucuggcgccuauggguaauggcacggggcggcgacgcgcuuuguga

SEQ ID NO: 18456 - RNA, 1620 nt, Artificial Sequence
  derived and/or modified sequence opt3 from VP1__Norovirus__AHH44889
augaagauggccagcaacgacgcuucccccucugauggcucagcagccaaucuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucguuguggacguccgccaacuggagccagugcuuauaccccugccugaugugcgaaauaacuuuuaucacuacaaucagagcaaggacccaaccaucaaauugauugcuaugcucuauacaccccugcgugccaacaaugcgggggaagaugucuucacuguuaguugcagagugcugaccaggccguccccugacuuugauuucaucuuucucguacccccaacaguggagucucggagcaagccuuucaccguccccauuuuaacuguggaagagaugacaaacucccgcuuuccaaucccccuggagaaacuuuucaccggaccuucaggugccuucguugugcagccacagaacggcagauguacgacugacggggucuugcugggaaccacacaacuaaguccggugaauauaugcacuuuuaggggcgaucucacccauuucacagguaccagcgaauacgcaaugaaccuggcuucucagaauuggaacaauuaugaccccacggaggaaauuccugccccacuuggggcucccgauuuuguaggaaagauccggggcaugcugacucagacaacccgccgagacggcuccacuagagggcacagggccacauugucaaccggaagcgcacauuucacgccuaagcucgguaguauucgguuuucuaccgacacaaacaaugauuucgaggccggccagaacacuaaauuuaccccaguugggaucuuccaagaaggagacaaucaccagaacgagccccagcaaugggugcugccgaauuacuccggcgcuacagcgcacaacguccauuuagccccugcaguggcuccagccuuucccggugagcagcuccucuucuuucguagcacuaugccuggguguggcggauaccccaauaugaaccuugauugccuguugccacaggaauggguccagcacuucuaucaagaggcagccccugcucagucggacguggcccuacugcgcuuuguuaaucccgauaccucuagagugcuguucgaauguaagcugcauaaauccggcuacguaacagucgcacacaccgggcagcacgaccuugugaucccaccgaacggauauuucagguuugauucauggguuaaccaguucuacacucuggcgccuauggguaauggcacggggcggcgacgcgcuuuguga

SEQ ID NO: 18457 - RNA, 1620 nt, Artificial Sequence; identical to SEQ ID NO: 18455
  derived and/or modified sequence opt3 from VP1__Norovirus__AHH44890

SEQ ID NO: 18458 - RNA, 1620 nt, Artificial Sequence; identical to SEQ ID NO: 18455
  derived and/or modified sequence opt3 from VP1__Norovirus__AHH44891

SEQ ID NO: 18459 - RNA, 1620 nt, Artificial Sequence; identical to SEQ ID NO: 18455
  derived and/or modified sequence opt3 from VP1__Norovirus__AHH44893

SEQ ID NO: 18460 - RNA, 1620 nt, Artificial Sequence
  derived and/or modified sequence opt3 from VP1__Norovirus__AHH44894
augaagauggccagcaacgacgcuucccccucugauggcucagcagccaaucuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucguuguggacguccgccaacuggagccagugcuuauaccccugccugaugugcgaaauaacuuuuaucacuacaaucagagcaaggacccaaccaucaaauugauugcuaugcucuauacaccccugcgugccaacaaugcgggggaagaugucuucacuguuaguugcagagugcugaccaggccguccccugacuuugauuucaucuuucucguacccccaacaguggagucucggagcaagccuuucaccguccccauuuuaacuguggaagagaugacaaacucccgcuuuccaaucccccuggagaaacuuuucaccggaccuucaggugccuucguugugcagccacagaacggcagauguacgacugacggggucuugcugggaaccacacaacuaaguccggugaauauaugcacuuuuaggggcgaucucacccauuucacagguaccagcgaauacgcaaugaaccuggcuucucagaauuggaacaauuaugaccccacggaggaaauuccugccccacuuggggcucccgauuuuguaggaaagauccggggcaugcugacucagacaacccgccgagacggcuccacuagagggcacagggccacauugucaaccggaagcgcacauuucacgccuaagcucgguaguauucgguuuucuaccgacacaaacaaugauuucgaggccucccagaacacuaaauuuaccccaguuggcguguuccaagaaggggacaaucaccagaacgagccccagcaauggguccugccgaauuacagcggagcuacagcgcacaacgugcauuuagccccugcagucgcuccagccuuucccggcgagcagcuccuguucuuucguucgacuaugccugguugugggggcuaccccaauaugaaccuugauugccuguugccacaggaaugggugcagcacuucuaucaagaggcagccccugcucagucugacguugcccuacugcgcuuugugaaucccgauaccuccagaguacucuucgaauguaagcugcauaaaucaggauacgucacaguggcacacaccggccagcacgaccuuguuaucccaccgaacggguauuucagguuugauaguugggugaaccaguucuacacucuggcgccuaugggaaaugguacgggccggcgacgcgcuuuguga

SEQ ID NO: 18461 - RNA, 1620 nt, Artificial Sequence
  derived and/or modified sequence opt3 from VP1__Norovirus__AHH44895
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccggugccuucguugugcagccacagaauggcagauguacgacugacggggucuugcugggaaccacacaacuaucaccggugaacauaugcacuuuuaggggcgaucucacccauuucacagguaccagugaauacgcaaugaaucuggcuagccagaacugggacaauuaugaucccacggaggaaauuccugccccacuuggggcucccgacuuuguaggaaagauccggggcaugcugacucagacaacccgccgagacggcucuacuagagggcacagggccacauuguccaccggaucagcacauuucacgccuaagcucgguaacauucgguuuagcaccgauacaaauaacgacuucgaggccggccagaauacuaaauuuaccccaguugggguguuccaagaaggagauaaccaccagaaugagccccagcaauggguccugccgaacuacaguggcgcuacagcgcacaaugugcauuuagccccugcagucgcuccagccuuucccggugagcagcuccuguucuuucguucuacuaugccuggguguggcggauaccccaacaugaaucuugacugccuguugccacaggaaugggugcagcacuucuaucaagaggcagccccugcucaguccgauguugcccuacugcgcuuugugaaccccgacaccagcagaguacucuucgaauguaagcugcauaaaucgggcuacgucacaguggcacacaccgggcagcacgaucuuguuaucccaccgaacggauauuucagguuugacucuugggugaaucaguucuacacucuggcgccuauggguaacggcacggggcggcgacgcgcuuuguga

SEQ ID NO: 18462 - RNA, 1620 nt, Artificial Sequence; identical to SEQ ID NO: 18455
  derived and/or modified sequence opt3 from VP1__Norovirus__AHH44896

SEQ ID NO: 18463 - RNA, 1620 nt, Artificial Sequence; identical to SEQ ID NO: 18455
  derived and/or modified sequence opt3 from VP1__Norovirus__AHH44897

SEQ ID NO: 18464 - RNA, 1620 nt, Artificial Sequence; identical to SEQ ID NO: 18455
  derived and/or modified sequence opt3 from VP1__Norovirus__AHH44899

SEQ ID NO: 18465 - RNA, 1620 nt, Artificial Sequence
  derived and/or modified sequence opt3 from VP1__Norovirus__AHH44900
augaagauggccagcaacgacgcuucccccucugauggcucagcagccaaucuggugccugaggucaacaaugaaguuauggcgcucgagccagugguaggggcuaccaucgccgcaccgguggccggacagcaaaacgucaucgaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucguuguggacguccgccaacuggagccagugcuuauaccccugccugaugugcgaaacaauuuuuaucacuacaaccagucaaaggacccaacaaucaaauugauugcaaugcucuauacuccccugcgugcuaauaacgccggggaagaugucuucaccguuagcugcagagugcugacaaggccgaguccugacuuugauuucaucuuucucguaucccccaccguggagucucggagcaagccauucacugucccuauuuuaacaguggaagagaugaccaacucccgcuuucccaucccacuggagaaacuuuucacgggacccucaggugcguucguugugcagccucagaauggcagauguacuaccgacggggucuugcugggaacaacucaacuaaguccagugaacauaugcaccuuuaggggcgaucucacacauuucaccgguacgagcgaauacgccaugaaucuggcaucucagaacuggaauaacuaugacccgacugaggaaauucccgcuccucuuggggccccagauuuuguaggaaagauccggggcaugcugacacagaccacucgccgagacggcuccacaagagggcacagggcuaccuugucaacgggaagcgcccauuucacccccaagcucgguaauauucgguuuaguacagacacuaacaaugauuucgaggcaggccagaacaccaaauuuacaccuguugggguguuccaagaaggagacaaucaccagaacgagccacagcaauggguccugcccaauuacucuggcgccacugcucacaacgugcauuuagcgccggcagucgccccugcuuuuccaggugagcagcuccuguucuuucguuccaccaugcccggguguggcggauacccuaauaugaaccuugauugccuguugccccaggaaugggugcagcacuucuaucaagaggccgcaccagcccagagcgacguugcucuacugcgcuuugugaacccugauacaucgagaguacucuucgaauguaagcugcauaaaucuggcuacgucaccguggcccacacugggcagcacgaccuuguuauucccccaaauggauauuucagguuugauuccugggugaaccaguucuacacgcuggcaccgauggguaauggcacagggcggcgacgcgcguuguga

SEQ ID NO: 18466 - RNA, 1620 nt, Artificial Sequence; identical to SEQ ID NO: 18455
  derived and/or modified sequence opt3 from VP1__Norovirus__AHH44902

SEQ ID NO: 18467 - RNA, 1620 nt, Artificial Sequence
  derived and/or modified sequence opt3 from VP1__Norovirus__AHH44904
augaagauggccagcaacgacgcuucccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguaucccccacaguggagucucggagcaagccauucaccgucccuauuuuaacuguggaagagaugacaaacucccgcuuucccaucccacuggagaaacuuuucaccggacccucaggugccuucguugugcagccucagaauggcagauguacgacugacggggucuugcugggaaccacacaacuaaguccagugaacauaugcacuuuuaggggcgaucucacccauuucacagguaccagcgaauacgcaaugaaucuggcuucucagaacuggaauaacuaugacccgacggaggaaauucccgccccucuuggggcuccagauuuuguaggaaagauccggggcaugcugacucagacaacccgccgagacggcuccacuagagggcacagggccacauugucaaccggaagcgcacauuucacgcccaagcucgguaauauucgguuuaguaccgacacaaacaaugauuucgaggccggccagaacacuaaauuuaccccuguugggguguuccaagaaggagacaaucaccagaacgagccacagcaauggguccugcccaauuacucuggcgcuacagcgcacaacgugcauuuagcaccggccgucgcuccugccuuuccaggugagcagcuccuguucuuucguuccacuaugcccggguguggcggauacccuaauaugaaccuugauugccuguugccccaggaaugggugcagcacuucuaucaagaggcagccccagcucagagcgacguugcccuacugcgcuuugugaacccugauaccucgagaguacucuucgaauguaagcugcauaaaucuggcuacgucacaguggcacacaccgggcagcacgaccuuguuauucccccaaauggauauuucagguuugauuccugggugaaccaguucuacacucuggcgccgauggguaauggcacggggcggcgacgcgcuuuguga

SEQ ID NO: 18468 - RNA, 1620 nt, Artificial Sequence; identical to SEQ ID NO: 18455
  derived and/or modified sequence opt3 from VP1__Norovirus__AHH44905

SEQ ID NO: 18469 - RNA, 1620 nt, Artificial Sequence
  derived and/or modified sequence opt3 from VP1__Norovirus__AHH44906
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacauacagccgcuuuccaaucccccuggagaaacuuuucaccggaccuuccucagccuucguugugcagccacagaacgguagauguacgacugacggcgucuugcuggggaccacacaacuaaguccggugaauauaugcacuuuuaggggagaucucacccauuucgcaggcacaagcgaauaugcuaugaaccuggccucucagaauuggaccaacuacgaccccacggaggaaauuccugcuccacuuggugcccccgauuuuguagggaagauccggggaguucugacucagacaacccgcggcgacggcuccacucgagggcacagagcaacauugucaaccggaagcgcccauuucacgccuaagcucgguagugugagguuuucuaccgacacaaauaacgauuucgaggcuggccagaauacuaaauuuaccccagucgggguguuccaagacggagauaaccaccagaaugaaccccagcaauggguccugccgaacuacuccggcgcgacagcacacaaugugcauuuagccccugcuguugccccagcauuucccggugagcagcuccucuucuuucggagcacuaugccuggguguucgggcuaucccaacaugaaucuugacugccuguugccacaggagugggugcagcacuucuaccaagaagccgcuccugcccagucugauguagcacuacugcguuuugucaaccccgacaccucccgcgugcuguucgaguguaagcugcauaaaucaggauauguuacaguggcgcacaccggccagcacgaucuugucauuccaccgaauggguacuucagauuugacaguugggugaaccaguucuauacucuggcuccuaugggaaacgguacgggcaggcggcgagccuuguga

SEQ ID NO: 18470 - RNA, 1620 nt, Artificial Sequence
  derived and/or modified sequence opt3 from VP1__Norovirus__AHH44907
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaaauucgugcaggcaccugguggcgaauuuaccguuaguccaaggaacgcccccggggagauccuuuggagcgcuccucugggaccagauuugaaucccuacuuaucccaccuggcccggauguauaacggcuacgcggguggguucgaagugcaggucauucuagcaggaaaugccuuuacagcuggcaagaucauuuucgccgcagugccuccaaacuuuccgacugagggccucucucccucgcagguaacgauguucccucauaucguuguggacguccgccaacuggagccagugcuuauaccccugccugaugugcgaaauaacuuuuaucacuacaaucagucaaaagacccaaccaucaaguugauugcuaugcucuauacaccccugcgugccaacaaugcgggggaagaugucuucacuguuagcugcagagugcugaccaggccgaguccugacuuugauuucaucuuucucguacccccaacaguggagucccggucuaaaccuuucaccguccccauuuuaacuguggaagagaugacaaacagccgcuuuccaaucccccuggagaagcuguucaccggaccuuccggugccuucguugugcagccacagaacggcagauguacgacugacggggucuugcugggaaccacacaacuaucaccggugaauauaugcacuuuuaggggcgaucucacccauuucgcagguacacacgaauacgcuaugaaccuggccagucagaauuggaacaauuaugaccccaccgaggaaauuccugcuccacuuggggcccccgauuuuguaggaaagauccggggcguucugacgcagacuacacgccgagacggcagcaccagagggcauagggcaacuuugucuacaggauccgcccacuucaccccuaaacucgguucaauucgguuuagcacggacaccaacaaugauuucgaggcuggccagaacacaaaguuuacuccagugggggucuuccaagacggagauaaucaccagaacgaaccccagcaaugggugcugccgaauuacaguggcgcgaccgcacauaacguccacuuagccccugcuguggccccagcauuucccggugagcagcuucucuucuuucguucuacaaugccuggguguuccggcuaccccaauaugaaccuugacugccuguugccacaggaguggguucagcauuucuaucaagaagccgcuccugcccagagcgauguggcacuacugcgcuuuguaaaucccgacacuucgagaguccucuucgaguguaaacugcacaagucuggauacgugaccguugcgcacacaggccagcaugaucuugugaucccaccgaacggguauuucagguuugacuccugggucaaccaguucuacacccuggcuccuaugggaaaugguacuggccggcgaugcgccuuguga

SEQ ID NO: 18471 - RNA, 1620 nt, Artificial Sequence
  derived and/or modified sequence opt3 from VP1__Norovirus__AHH44908
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccucagccuucguugugcagccacagaaugguagauguacgacugacggcgucuugcuggggaccacacaacuaaguccggugaacauaugcacuuuuaggggagaucucacccauuucgcaggcacaagcgaauacgcuaugaaucuggccucucagaacuggaccaauuaugaccccacggaggaaauuccugcuccacuuggugcccccgauuuuguagggaagauccggggaguucugacucagacaacccgcggcgacggcuccacucgagggcacagagcaacauugucaaccggaagcgcccauuucacgccuaagcucgguagugugagguuuucuaccgacacaaacaaugauuucgaggcuggccagaacacuaaauuuaccccagucgggguguuccaagacggagauaaucaccagaacgaaccccagcaauggguccugccgaauuacuccggcgcgacagcacacaacgugcauuuagccccugcuguugccccagcauuucccggugagcagcuccucuucuuucggagcacuaugccuggguguucgggcuaccccaauaugaaccuugacugccuguugccacaggagugggugcagcacuucuaucaagaagccgcuccugcccagucugauguagcacuacugcguuuugucaaucccgacaccucccgcgugcuguucgaguguaagcugcauaaaucaggauacguuacaguggcgcacaccggccagcacgaucuugucauuccaccgaacggguauuucagauuugacaguugggugaaccaguucuacacucuggcuccuaugggaaaugguacgggcaggcggcgagccuuguga

SEQ ID NO: 18472 - RNA, 1620 nt, Artificial Sequence
  derived and/or modified sequence opt3 from VP1__Norovirus__AHH44909
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgugggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccgggccuuccggagccuucguugugcagccacagaaugguagauguacgacugacggcgucuugcuggggaccacacaacuaucaccggugaacauaugcacuuuuaggggagaucucacccauuucgcaggcacacacgaauacgcuaugaaucuggccagucagaacuggaauaacuaugaccccaccgaggaaauuccugcuccacuuggugcccccgauuuuguagggaagauccggggaguucugacgcagacuacacgccgagacggcagcaccagaggccauagggcaacuuugucuacaggguccgcccacuucaccccuaagcucggaucaauucgguuuagcacggacaccaauaacgauuucgaggcuggucagaauacaaaauuuacuccagugggcgucuuccaagacggggauaaccaccagaaugaaccccagcaaugggugcugccgaacuacaguggagcgaccgcacauaauguccacuuagccccugcuguggccccagcauuucccggcgagcagcuccuguucuuucguucuacaaugccugguuguuccggguaccccaacaugaaucuugacugccuguugccacaggaguggguucagcauuucuaucaagaagccgcuccugcccagagcgauguggcacuacugcgcuuuguaaaccccgacacuucgagaguccucuucgaguguaagcugcacaaaucuggcuacgugaccguugcgcacacaggacagcaugaucuugugaucccaccgaacggcuauuucagguuugacuccugggucaaucaguucuacacccuggcuccuauggggaacggaacuggucggcgacgcgccuuguga

SEQ ID NO: 18473 - RNA, 1620 nt, Artificial Sequence
  derived and/or modified sequence opt3 from VP1__Norovirus__AHH44911
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccggugccuucguugugcagccacagaauggcagauguacgacugacggggucuugcugggaaccacacaacuaucaccggugaacauaugcacuuuuaggggcgaucucacccauuucgcagguacacacgaauacgcuaugaaucuggccagucagaacuggaauaacuaugaccccaccgaggaaauuccugcuccacuuggggcccccgauuuuguaggaaagauccggggcguucugacgcagacuacacgccgagacggcagcaccagagggcauagggcaacuuugucuacaggauccgcccacuucaccccuaagcucgguucaauucgguuuagcacggacaccaauaacgauuucgaggcuggccagaauacaaaauuuacuccagugggggucuuccaagacggagauaaccaccagaaugaaccccagcaaugggugcugccgaacuacaguggcgcgaccgcacauaauguccacuuagccccugcuguggccccagcauuucccggugagcagcuccuguucuuucguucuacaaugccuggguguuccggcuaccccaacaugaaucuugacugccuguugccacaggaguggguucagcauuucuaucaagaagccgcuccugcccagagcgauguggcacuacugcgcuuuguaaaccccgacacuucgagaguccucuucgaguguaagcugcacaaaucuggauacgugaccguugcgcacacaggccagcaugaucuugugaucccaccgaacggguauuucagguuugacuccugggucaaucaguucuacacccuggcuccuaugggaaacgguacuggccggcgacgcgccuuguga

SEQ ID NO: 18474 - RNA, 1620 nt, Artificial Sequence
  derived and/or modified sequence opt3 from VP1__Norovirus__AHH44912
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccggugccuucguugugcagccacagaauggcagauguacgacugacggggucuugcugggaaccacacaacuaucaccggugaacauaugcacuuuuaggggcgaucucacccauuucgcagguacacacgaauacgcuaugaaucuggccagucagaacuggagcaauuaugaccccaccgaggaaauuccugcuccacuuggggcccccgauuuuguaggaaagauccggggcguucugacgcagacuacacgcggcgacgggucuacccgaggacauagagcaacuuuguccacagguucagcccacuucaccccuaagcucggcagcauuagguuuaguacggacaccaacaaugauuucgaggcugggcagaacacaaaauuuacuccagugggagucuuccaagacggcgauaaucaccagaacgaaccccagcaaugggugcugccgaauuacucuggugcgaccgcacauaacguccacuuagccccugcuguggccccagcauuucccggggagcagcuccuguucuuucgguccacaaugccuggcuguagcggauaccccgacaugaaucuugauugccuguugccacaggaguggguucagcauuucuaucaagaagccgcuccugcccagucggacguggcacuacugcguuuuguaaaccccgauacuucucgcguccucuucgaguguaagcugcacaaauccggcuacgugaccguugcgcacacagggcagcaugaccuugugaucccaccgaauggauauuucagauuugauucaugggucaaccaguucuacacccuggcuccuauggguaacggcacugggaggcggcgagccuuguga

SEQ ID NO: 18475 - RNA, 1620 nt, Artificial Sequence
  derived and/or modified sequence opt3 from VP1__Norovirus__AHH44913
augaagauggccagcaacgacgcuucccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccucagccuucguugugcagccacagaaugguagauguacgacugacggcgucuugcuggggaccacacaacuaaguccggugaacauaugcacuuuuaggggagaucucacccauuucgcaggcacaagcgaauacgcuaugaaucuggccucucagaacuggaccaauuaugaccccacggaggaaauuccugcuccacuuggugcccccgauuuuguagggaagauccggggaguucugacucagacaacccgccgagacggcuccacuagaggccacagggcaacauugucaaccgggagcgcccauuucacgccuaagcucggaaguauucgguuuucuaccgacacaaacaaugauuucgaggcuggucagaacacuaaauuuaccccagugggcgucuuccaagacggggauaaucaccagaacgaaccccagcaaugggugcugccgaauuacuccggagcgacagcacacaacguccauuuagccccugcuguggccccagcauuucccggcgagcagcuccuguucuuucguagcacuaugccugguuguucgggguaccccaauaugaaccuugacugccuguugacccaggaguggguucagcacuucuaucaagaagccgcuccagcccagucugauguggcacuacugcgcuuuguaaauccugacacauccagaguccucuucgaguguaagcugcauaaaucaggcuacgugaccguugcgcacacuggacagcacgaucuugugauucccccaaacggcuauuucagguuugacaguugggucaaccaguucuacacgcuggcuccgauggggaauggaacaggucggcgacgcgccuuguga

SEQ ID NO: 18476 - RNA, 1620 nt, Artificial Sequence
  derived and/or modified sequence opt3 from VP1__Norovirus__AHH44914
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccucagccuucguugugcagccacagaaugguagauguacgacugacggcgucuugcuggggaccacacaacuaaguccggugaacauaugcacuuuuaggggagaucucacccauuucgcaggcacacacgaauacgcuaugaaucuggccagccagaacuggaccaauuaugaccccacggaggaaauuccugcuccacuuggugcccccgauuuuguagggaagauccggggaguucugacucagacaacccgcggcgacggcucuacucgagggcauagagcaacauuguccaccggaucagcccacuucacgccuaagcucgguagcgugagguuuaguaccgacacaaacaaugauuucgaggcuggccagaacacuaaauuuaccccagucgggguguuccaagacggagauaaucaccagaacgaaccccagcaauggguccugccgaauuacucuggcgcgacagcacauaacgugcacuuagccccugcuguugccccagcauuucccggugagcagcuccucuucuuucgguccacuaugccuggguguagcggcuaccccaauaugaaccuugacugccuguugccacaggagugggugcagcauuucuaucaagaagccgcuccugcccagucggauguagcacuacugcguuuugucaaucccgacaccucucgcgugcuguucgaguguaagcugcacaaauccggauacguuacaguggcgcacaccggccagcaugaucuugucauuccaccgaacggguauuucagauuugacucaugggugaaccaguucuacacucuggcuccuaugggaaaugguacgggcaggcggcgagccuuguga

SEQ ID NO: 18477 - RNA, 1620 nt, Artificial Sequence
  derived and/or modified sequence opt3 from VP1__Norovirus__AHH44915
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaggacccaaccaucaaauugauugcuaugcucuauacaccccugcgugccaauaacgcgggggaagaugucuucacuguuagcugcagagugcugaccaggccgaguccugacuuugauuucaucuuucucguacccccaacaguggagucccggucuaagccuuucaccguccccauuuuaacuguggaagagaugacaaacagccgcuuuccaaucccccuggagaaacuuuucaccggaccuuccucagccuucguugugcagccacagaaugguagauguacgacugacggcgucuugcuggggaccacacaacuaaguccggugaacauaugcacuuuuaggggagaucucacccauuucgcaggcacaagcgaauacgcuaugaaucuggccucucagaacuggaccaauuaugaccccacggaggaaauuccugcuccacuuggugcccccgauuuuguagggaagauccggggaguucugacucagacaacccgccgagacggcuccacuagaggccacagggcaacauugucaaccgggagcgcccauuucacgccuaagcucggaaguauucgguuuucuaccgacacaaacaaugauuucgaggcuggucagaacacuaaauuuaccccagugggcgucuuccaagacggggauaaucaccagaacgaaccccagcaaugggugcugccgaauuacuccggagcgacagcacacaacguccauuuagccccugcuguggccccagcauuucccggcgagcagcuccuguucuuucguagcacuaugccugguuguucgggguaccccaauaugaaccuugacugccuguugccacaggaguggguucagcacuucuaucaagaagccgcuccugcccagucugauguggcacuacugcgcuuuguaaaucccgacaccuccagaguccucuucgaguguaagcugcauaaaucaggcuacgugacaguugcgcacaccggacagcacgaucuugugaucccaccgaacggcuauuucagguuugacaguugggucaaccaguucuacacucuggcuccuauggggaauggaacgggucggcgacgcgccuuguga

SEQ ID NO: 18478 - RNA, 1623 nt, Artificial Sequence; identical to SEQ ID NO: 18265
  derived and/or modified sequence opt3 from VP1__Norovirus__AID60853

SEQ ID NO: 18479 - RNA, 1623 nt, Artificial Sequence; identical to SEQ ID NO: 18313
  derived and/or modified sequence opt3 from VP1__Norovirus__AID60855

SEQ ID NO: 18480 - RNA, 1623 nt, Artificial Sequence; identical to SEQ ID NO: 18313
  derived and/or modified sequence opt3 from VP1__Norovirus__AID60857

SEQ ID NO: 18481 - RNA, 1623 nt, Artificial Sequence; identical to SEQ ID NO: 18313
  derived and/or modified sequence opt3 from VP1__Norovirus__AID60859

SEQ ID NO: 18482 - RNA, 1623 nt, Artificial Sequence
  derived and/or modified sequence opt3 from VP1__Norovirus__AID60861
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaucgggagugcugauuuugccccuaagcugggaagagugcaauucgagaccgacacagaucaugacuuugaagcaaaucagaacacuaaauucaccccaguuggugugauucaggauggcucuacaacucacaggaaugagccccaacaguggguauugccguccuacagcgggcggaacaccccuaauguccaccucgccccagcuguggcgcccacauuuccuggagaacagcuguuauucuuucguucgaccaugcccggcuguucugguuauccaaacauggaccuggauugccuccuuccucaggaguggguucaauacuucuaucaggaggcagcccccgcucaguccgacguggcccuguugcgcuuugucaauccagauacugggagagugcuauucgaauguaagcugcauaaaucaggcuacguaacgguggcacacacaggacagcaugaccucguuaucccgccuaacggcuauuuuagguucgauaguugggucaaucaauucuacacccuggcccccauggggaacggaacuggucggcgacgcgcucuuuga

SEQ ID NO: 18483 - RNA, 1623 nt, Artificial Sequence
  derived and/or modified sequence opt3 from VP1__Norovirus__AID60863
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugaucaugacuuugaagcaaaucagaacaccaaauucacaccaguuggugugauccaggauggcucuacuacccacaggaaugagccccaacaguggguauugccguccuacagcgggcggaacacaccuaauguccaccucgccccagcuguggcgcccaccuuuccuggagaacagcuguuauucuuucguucgacuaugcccggcuguucugguuauccaaacauggaccuggauugccuccuuccucaggaguggguucaauacuucuaucaggaggcagcccccgcucaguccgacguggcccuguugcgcuuugucaauccagauacggggagagugcuauucgaauguaagcugcauaaaucaggcuacguaacaguggcacacaccggacagcaugaccucguuauuccgccuaacggcuauuuuagguucgauaguugggucaaucaauucuacacucuggcccccauggggaacggaaccggucggcgacgcgcucuuuga

SEQ ID NO: 18484 - RNA, 1623 nt, Artificial Sequence
  derived and/or modified sequence opt3 from VP1__Norovirus__AID60865
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauguggucauugacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugaucaugacuuugaaaccaaucagaacacaaaauucacuccaguuggugugauccaggauggcgggaccacacacaggaaugagccccaacaguggguauugccgucuuacuccggacggaacaccccuaauguccaccucgcaccagccguggcucccacuuuuccuggcgaacagcuguuauucuuucguagcacgaugcccgguuguucgggguauccaaacauggaccuggauugccuccuuccucaggaguggguucaauacuucuaucaggaggcggcacccgcccagucugacguggcucuguugcgcuuugucaauccagauacaggcagagugcuauucgaauguaagcugcauaaauccggauacguaaccguggcccacacuggccagcaugaccucguuauuccgccuaacggguauuuuagguucgauucaugggucaaucaauucuacacccuggcacccaugggaaacgguacaggccggcgacgcgcccuuuga

SEQ ID NO: 18485 - RNA, 1623 nt, Artificial Sequence
  derived and/or modified sequence opt3 from VP1__Norovirus__AID60869
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucacaauuacaccaugaaccucgcaucccagaauuggucaaacuaugaucccacggaggaaauaccugcuccacuggguacucccgacuucgucgggaagauucagggagugcuuacacagaccacucggacaaauggcagcacccgcggccauaaggccacggucuacgcugggagugccaacuuugcaccuaagcugggacgagugcaauucgagaccgacacagaucacgacuuggaagccaaucagaacacuaaauuuaccccaguuggugugauccaggauggcaauacaacucacagaaacgagccccaacaguggguacucccgucuuacuccgggaggagcaccccuaauguccaucuggcuccagcgguggcacccacauucccuggagaacaguuacuguuuuuccggucgaccaugcccggcuguucugguuauccaaacauggaccucgauugccuucugccucaggaguggguucaauacuuuuaucaggaggccgcucccgcccaguccgacguggcauugcuacguuucgucaauccagauacugggcgcgugcuguuugaauguaagcuccacaaaucaggcuacguaacgguggcccauacaggacagcacgaccugguuauuccgccuaacggcuauuucagauuugauaguugggucaaccaauucuacacccuugcucccauggggaauggaacugguaggcggcgagcccuguga

SEQ ID NO: 18486 - RNA, 1623 nt, Artificial Sequence
  derived and/or modified sequence opt3 from VP1__Norovirus__AID60871
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaacgccccuggagaaacuuuucaccggaccuuccucagccuucgucgugcagccacagaacgguagauguacuaccgauggcguauugcuggggacaacucaacuaaguccgguuaauaucugcaccuuuaggggagacgugacacauauuaccggcagccggaacuacacgaugaaucucgcaucucagaacugguccaauuaugaucccacugaggaaaucccugcuccacuggguacacccgacuucgucgggaagauacagggagugcuuacccagacuacacgcaccgacggcucaacgcgaggccacaaggccaccgucuacacagggagcgcugauuuugccccuaagcugggaagagugcaauucgagacugacaccgaucaugacuuugaagcaaaccagaauacaaaauucacuccaguuggugugauucaggauggcaguaccacacacaggaacgagccccaacaguggguauugccgucuuacuccgggcggaauaccccuaacguccaccucgccccagcuguggcgcccacuuuuccuggagaacagcuguuauucuuucguagcacgaugcccggcuguucggguuauccaaauauggaccuggauugccuccuuccucaggaguggguucaauacuucuaucaggaggcagcccccgcucagucugacguggcccuguugcgcuuugucaacccagauacagggagagugcuauucgaauguaagcugcauaaauccggcuacguaaccguggcacacacuggacagcaugaccucguuaucccgccuaauggcuauuuuagguucgauucaugggucaaccaauucuacacccuggcccccauggggaacggaacaggucggcgacgcgcucuuuga

SEQ ID NO: 18487 - RNA, 1623 nt, Artificial Sequence
  derived and/or modified sequence opt3 from VP1__Norovirus__AID60875
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaccccacuggagaaacuuuucacgggacccucaagugccuucgucgugcagccucagaacgguagauguacuaccgauggcguauugcuggggacaacucaacuaagcccaguuaauaucugcaccuuuaggggagacgugacacauauuaccggcucucggaacuacacgaugaaucucgcaucccagaacuggucaaauuaugauccgacugaggaaauccccgcuccucuggguacaccagacuucgucgggaagauacagggagugcuuacccagacuacacgcaccgacggcagcacgcgaggccacaaggccaccgucuacacagggagugcugauuuugcccccaagcugggaagagugcaauucgagacugacaccgaucaugacuuugaaacaaaccagaauacuaaauucaccccuguuggugugauucaggauggcucuacaacccacaggaacgagccacaacaguggguauugcccuccuacagcgggcggaauacuccgaacguccaccucgccccugcaguggcuccaacguuucccggagaacagcuguuauucuuucguucgacaaugccuggcuguucugguuaucccaauauggaccuggauugccuccuuccacaggaguggguucaauacuucuaucaggaggcggccccugcacaguccgacguggcucuguugcgcuuugucaaccccgauaccgggagagugcuauucgaauguaagcugcauaaaucaggcuacguaacuguggcccacaccggacagcaugaccucguuaucccaccgaauggcuauuuuagguucgagaguugggucaaccaauucuacacacuggcaccuauggggaacggaaccggucggcgacgcgcccuuuga

SEQ ID NO: 18488 - RNA, 1623 nt, Artificial Sequence
  derived and/or modified sequence opt3 from VP1__Norovirus__AID60877
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaccccacuggagaaacuuuucacgggacccucaagugccuucgucgugcagccucagaacgguagauguacuaccgauggcguauugcuggggacaacucaacuaagcccaguuaauaucugcaccuuuaggggagacgugacacauauuaccggcucucggaacuacacgaugaaucucgcaucccagaacuggucaaauuaugauccgacugaggaaauccccgcuccucuggguacaccagacuucgucgggaagauacagggagugcuuacccagacuacacgcaccgacggcagcacgcgaggccacaaggccaccgucuacacagggagugcugauuuugcccccaagcugggaagagugcaauucgagacugacaccgaucaugacuuugaaacaaaccagaauacuaaauucaccccuguuggugugauucaggauggcucuacaacccacaggaacgagccacaacaguggguauugcccuccuacagcgggcggaauacuccgaacguccaccucgccccugcaguggcuccaacguuucccggagaacagcuguuauucuuucguucgacaaugccuggcuguucugguuaucccaauauggaccuggauugccuccuuccacaggaguggguucaauacuucuaucaggaggcggccccugcacaguccgacguggcucuguugcgcuuugucaaccccgauaccgggagagugcuauucgaauguaagcugcauaaaucaggcuacguaacuguggcccacaccggacagcaugaccucguuaucccaccgaauggcuauuuuagguucgauaguugggucaaccaauucuacacacuggcaccuauggggaacggaaccggucggcgacgcgcccuuuga

SEQ ID NO: 18489 - RNA, 1623 nt, Artificial Sequence; identical to SEQ ID NO: 18488
  derived and/or modified sequence opt3 from VP1__Norovirus__AID60879

SEQ ID NO: 18490 - RNA, 1623 nt, Artificial Sequence
  derived and/or modified sequence opt3 from VP1__Norovirus__AID60881
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaccccacuggagaaacuuuucacgggacccucaagugccuucgucgugcagccucagaacgguagauguacuaccgauggcguauugcuggggacaacucaacuaagcccaguuaauaucugcaccuuuaggggagacgugacacauauuaccggcucucggaacuacacgaugaaucucgcaucccagaacuggucaaauuaugauccgacugaggaaauccccgcuccucuggguacaccagacuucgucgggaagauacagggagugcuuacccagacuacacgcaccgacggcagcacgcgaggccacaaggccaccgucuacacagggagugcugauuuugcccccaagcugggaagagugcaauucgagacugacaccgaucaugacuuugaaacaaaccagaauacuaaauucaccccuguuggugugauucaggauggcucuacaacccacaggaacgagccacaacaguggguauugcccuccuacagcgggcggaauacuccgaacguccaccucgccccugcaguggcuccaacguuucccggagaacagcuguuauucuuucguucgacaaucccuggcuguucugguuaucccaauauggaccuggauugccuccuuccacaggaguggguucaauacuucuaucaggaggcggccccugcacaguccgacguggcucuguugcgcuuugucaaccccgauaccgggagagugcuauucgaauguaagcugcauaaaucaggcuacguaacuguggcccacaccggacagcaugaccucguuauuccaccgaauggcuauuuuagguucgauaguugggucaaccaauucuacacacuggcaccuauggggaacggaaccggucggcgacgcgcccuuuga

SEQ ID NO: 18491 - RNA, 1623 nt, Artificial Sequence
  derived and/or modified sequence opt3 from VP1__Norovirus__AID60883
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccaucaguccaaggaaugcccccggggagauucuuuggagcgcuccucugggaccagauuugaaccccuacuuaucccaccuggcccggauguauaauggcuacgcggguggguucgaaguucaggugauccuagcaggaaacgccuuuacagcuggcaaagucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaugacagcaccaucaaguugauugcuaugcucuauacaccacugcgugccaacaacgcgggggaugacgucuucacuguuaguugcagagugcugaccaggcccuccccggauuuugaccucaucuucuuaguaccucccacaguggaaucucggaccaaaccauuuagcgucccugugcugacuguugaggaaaugacaaauucccgcuuccccaccccacuugagaaguuguuuacgggacccucaagugccuucgugguccagccucagaacgguagauguacuaccgauggcgugcugcuagggacaacucaacucagcccaguaaauauuugcaccuucaggggagacguuacacauaucaccggcucucggaacuacacgaugaaucuggcaucccagaacuggucaaauuaugauccgacugaggaaauacccgcuccucuugguacaccagacuuuguggggaaaauucagggaguccugacccagacuacacgcaccgacggcagcacgcgaggccacaaggccaccguguacacagggagugcugauuucgcccccaaguugggaagaguccaauuugagacugacaccgaucaugacuucgaaacaaaccagaauacuaaauuuaccccuguggguguuauccaggauggcucuacaacccacaggaacgagccacaacagugggugcuccccuccuacagcgggcggaauacuccgaacguacaccuggccccugcagucgcuccaacguuccccggagaacaguuacuguuuuuccguucgacaauuccuggcuguucugguuaucccaauauggaccucgauugccuucugccacaggagugggugcaauacuuuuaucaggaggcggccccugcacaguccgacguugcuuugcuacgcuucgugaaccccgauaccgggagaguccuguuugaauguaagcuccauaaaucaggcuacgugacuguagcccacaccggacagcaugaccuggugaucccaccgaauggcuauuucagguuugauaguuggguuaaccaauucuacacacuugcaccuauggggaacggaaccggucggcgacgcgcccuguga

SEQ ID NO: 18492 - RNA, 1623 nt, Artificial Sequence; identical to SEQ ID NO: 18488
  derived and/or modified sequence opt3 from VP1__Norovirus__AID60885

SEQ ID NO: 18493 - RNA, 1623 nt, Artificial Sequence
  derived and/or modified sequence opt3 from VP1__Norovirus__AID60887
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaacgccccuggagaaacuuuucaccggaccuuccucagccuucgucgugcagccacagaacgguagauguacuaccgauggcguauugcuggggacaacucaacuaaguccgguuaauaucugcaccuuuaggggagacgugacacauauuaccggcagccggaacuacacgaugaaucucgcaucucagaacugguccaauuaugaucccacugaggaaaucccugcuccacuggguacacccgacuucgucgggaagauacagggagugcuuacccagacuacacgcaccgacggcucaacgcgaggccacaaggccaccgucuacacagggagcgcugauuuugccccuaagcugggaagagugcaauucgagacugacaccgaucaugacuuugaaacaaaccagaauacuaaauucaccccaguuggugugauucaggauggcaguacaacccacaggaacgagccccaacaguggguauugccgucuuacuccgggcggaauacuccuaacguccaccucgcaccagccguggcucccacguuuccuggagaacagcuguuauucuuucguagcacaaugcccggcuguucggguuauccaaauauggaccuggauugccuccuuccucaggaguggguucaauacuucuaucaggaggcggcacccgcccagucugacguggcucuguugcgcuuugucaacccagauaccgggagagugcuauucgaauguaagcugcauaaauccggcuacguaacuguggcccacaccggacagcaugaccucguuaucccgccuaauggcuauuuuagguucgauucaugggucaaccaauucuacacacuggcacccauggggaacggaaccggucggcgacgcgcccuuuga

SEQ ID NO: 18494 - RNA, 1623 nt, Artificial Sequence
  derived and/or modified sequence opt3 from VP1__Norovirus__AID60889
augaagauggccagcuccgacgcuaaccccugcgauggcucugcagccaaucuggugccugaggucaacaaugaaguuauggcgcucgagccagugguaggggcugccaucgcagccccggugggaggucagcaaaacgucauugaccccuggauaagaaauaacuucgugcaggcuccuggcggggaauuuaccguuucaccaaggaaugcacccggagagauccuuuggagugccccucugggcccagauuugaaccccuacuuaagccaccuggcucggauguauaaugguuacgccgggggauucgaagugcaggucauucuagcgggcaacgcauuuacagccggcaaagugaucuucgcugccguaccuccaaauuuuccgacugaggggcucucccccucucagguuacgauguucccucauauuguggucgacgugcgccaacuggagccagugcuuaucccccugccugauguccgaaacaauuuuuaucacuacaaccagucgaaugacucaaccauaaaguugaucgcaaugcucuauacaccacugcgugcuaacaacgccggagaugacguuuucacugugagcuguagaguacugaccaggcccaguccggauuuugacuucauuuuucucgugccucccacagucgaaucccggaccaaaccauucucugugccuguuuuaacuguggaggaaaugacaaauagccgcuuucccaccccacuggagaaacuuuucacgggucccuccucagcguucgucgugcagccucagaacggcagaugcacuaccgaugggguauugcugggaacaacucaacuaaguccaguuaauaucuguaccuuuaggggcgacgugacacauauuaccgguagccggaacuacacgaugaaucucgccucucagaacugguccaauuaugauccgacugaggaaauccccgcaccucuggggacaccagacuucgucggaaagauacagggcgugcuuacccagacuacacgcaccgacggcucaacgcgagggcacaaggcuaccgucuacauuggaagcgccgauuuugcucccaagcuggguagagugcaauucgagacagacacugaucaugacuuugaaaccaaccagaauacaaaauucacuccuguuggcgugauccaggaugggaguaccacacacaggaacgagccacaacaguggguauugcccucuuacuccggacggaauaccccgaacguccaccucgccccugcaguggccccaacuuuucccggcgaacagcuguuauucuuucguagcacgcugccugguugcucgggguaucccaauauggaccucgauugucuucugccacaggaguggguucaauacuucuaucaggaggcugcgccugcacagucugacguggccuugcuacgcuuugucaaccccgauacaggcagagugcuguucgaaugcaagcuccauaaauccggauacguaaccguggcucacacuggccagcaugaccugguuauuccaccgaauggguauuuuagguucgauucaugggucaaccaauucuacacccuugccccuaugggaaacgguacaggccggcgacgcgcacuguga

SEQ ID NO: 18495 - RNA, 1623 nt, Artificial Sequence
  derived and/or modified sequence opt3 from VP1__Norovirus__AID60893
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaccccacuggagaaacuuuucacgggacccucaagugccuucgucgugcagccucagaacgguagauguacuaccgauggcguauugcuggggacaacucaacuaagcccaguuaauaucugcaccuuuaggggagacgugacacauauuaccggcucucggaacuacacgaugaaucucgcaucccagaacuggucaaauuaugauccgacugaggaaauccccgcuccucuggguacaccagacuucgucgggaagauacagggagugcuuacccagacuacacgcaccgacggcagcacgcgaggccacaaggccaccgucuacauugggagugcugauuuugcccccaagcugggaagagugcaauucgagacagacacugaucaugacuuugaaaccaaccagaauacaaaauucacuccuguuggugugauccaggauggcucuaccacacacaggaacgagccacaacaguggguauugcccuccuacagcgggcggaauaccccgaacguccaccucgccccugcaguggcuccaacuuuucccggagaacagcuguuauucuuucguucgacgcugccuggcuguucugguuaucccaauauggaccucgauugccuucugccacaggaguggguucaauacuucuaucaggaggcggccccugcacaguccgacguggcuuugcuacgcuuugucaaccccgauacagggagagugcuguucgaauguaagcuccauaaaucaggcuacguaaccguggcccacacuggacagcaugaccugguuauuccaccgaauggcuauuuuagguucgauaguugggucaaccaauucuacacccuugcaccuauggggaacggaacaggucggcgacgcgcccuguga

SEQ ID NO: 18496 - RNA, 1623 nt, Artificial Sequence
  derived and/or modified sequence opt3 from VP1__Norovirus__AID68577
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggaaugcuuacacagaccacucgcacagacggcucaacccgaggccacaaggccacgguguacaccgggagcgcugauuuugccccuaagcugggaagaguccaauucgagacagacacugauagggacuuugaagcaaaccagaauaccaaauucacaccaguggguguuauccaggauggcaguacuacccaucggaacgagccccaacaguggguguugccgucuuacuccgggcguaauacaccuaacguacaccucgccccagcugucgcgcccaccuuuccuggagaacagcuguuauucuuucgcagcacuaugcccggcuguucggguuauccaaauauggaccuggauugccuccuuccucaggagugggugcaauacuucuaucaggaggcagcccccgcucagucugacguugcccuguugagauuugugaacccagauacggggaggguccuauucgaauguaagcugcacaaauccggcuacgugacaguagcacauaccggacagcacgaccucgugauuccgccuaauggcuauuuucgguucgauucauggguuaaccaauucuacacucuggcccccauggggaacggaaccggucgacgcagagcucuuuga

SEQ ID NO: 18497 - RNA, 1623 nt, Artificial Sequence
  derived and/or modified sequence opt3 from VP1__Norovirus__AID68578
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuuagcccuaagcugggacgaauccaauucgagacagacacuaaucacgauuuugaagccaaccagaauaccaaauucacaccaguggguguuauucaggacggcgggacuacccacagaaacgagccccaacaguggguguugccgaguuacucuggaaggaauacaccuaacguacaucucgcaccagccgucgcucccaccuuuccuggcgaacagcuguuauucuuucgguccacuaugcccgguuguagcggguauccaaauauggaucuggacugccuccuuccucaggagugggugcaauacuucuaucaggaggcggcacccgcccagucggauguugcucuguugcguuuugugaacccagacacgggccgcguccuauucgaauguaagcugcacaaaucuggauacgugacaguagcccauaccggccagcacgaucucgugaucccgccuaacggguauuuuagauucgacuccuggguuaaucaauucuacacucuggcacccaugggaaacgguaccggcaggcggcgagcccuuuga

SEQ ID NO: 18498 - RNA, 1623 nt, Artificial Sequence
  derived and/or modified sequence opt3 from VP1__Norovirus__AID68579
augaagauggccagcuccgacgcuaaccccucugauggcucagcagccaaucuggugccugaggucaacaaugaaguucucgcgcuugagccagugguaggggcugccaucgcagccccgguggcuggacagcaaaacgucauugaccccuggauaagaaauaacuucgugcaggcaccugguggcgaauuuaccguuaguccaaggaaugcccccggggagauccuguggagcgcuccuuugggaccagauuuaaaccccuaccugucccaccuagcccggauguauaauggcuacgcggguggguucgaagugcaggucauucucgcaggaaacgccuuuacagcuggcaaagugaucuucgccgcaguaccuccaaauuuuccgacugagggccugucucccucgcagguuacgauguucccucauauuguggucgacgugcgccaacuugagccagugcugauccccuugccugauguccgaaacaauuuuuaucacuacaaccagucaaaugacccaaccauaaagcucaucgcuaugcuguauacaccccugcgugccaacaacgcgggggaugacguuuucacugugagcugcagaguacucaccaggccgaguccugauuuugacuucaucuuuuuagugcccccaacagucgaaucccggaccaaaccuuucucugugcccguucugacuguggaggaaaugacaaauagccgcuuuccaauuccccuugagaaguuguucaccggaccuuccucagccuucgucgugcagccacagaacgguagauguacgacugauggcguacugcuagggaccacacaacucaguccgguuaauauuugcacuuuuaggggagacgugacccauaucacaggcagccacaacuacaccaugaaucuggcaucucagaacuggaauaacuaugaucccacggaggaaauaccugcuccacuugguacucccgacuucgucgggaaaauucagggagugcugacacagaccacucggacagacggcuccacccgcggccauaaggccacggucuacaccgggucagcugauuuuagcccuaaguugggacgaauccaauucgagacagacacuaaucacgauuuugaagccaaccagaauaccaaauucacaccaguggguguuauucaggacggcgggacuacccacagaaacgagccccaacagugggugcucccgaguuacucuggaaggaauacaccuaacguacaucuggcaccagccgucgcucccaccuuuccuggcgaacaguuacuguucuuucgguccacuaugcccgguuguagcggguauccaaauauggaucucgacugccuucugccucaggagugggugcaauacuucuaucaggaggcggcacccgcccagucggauguugcuuugcuacguuuugugaacccagacacgggccgcguccuguucgaauguaagcuccacaaaucuggauacgugacaguagcccauaccggccagcacgaucuggugaucccgccuaacggguauuuuagauucgacuccuggguuaaucaauucuacacucuugcacccaugggaaacgguaccggcaggcggcgagcccuguga

SEQ ID NO: 18499 - RNA, 1623 nt, Artificial Sequence; identical to SEQ ID NO: 18321
  derived and/or modified sequence opt3 from VP1__Norovirus__AID68581

SEQ ID NO: 18500 - RNA, 1623 nt, Artificial Sequence
  derived and/or modified sequence opt3 from VP1__Norovirus__AID69174
augagaauggccagcgacgaugcuaaguccgcacccucugaccuggagggcgccgggcucgugccugcgaccgcugccccacuuccggucgcacccguugccggagcucaggcagccgaaccuuucgcuggucaaaucaacgugauugauccauggauauacacaaauuuuguacaggcccccacuggcgaguucacggugucaccuaggaacaccccaggggaaguccuggugaauuuggagaucggacccaacuuaaauccuuaucugcagcaccuagcgcagauguacaacggcuaugccggugggguugaagugcaagucauucucgcaggaaaugcuuuuacagccggcaaacugcuuugcgcacuggugccaccgggcuuccccaccaguagcaucacuccugcucaguugacaaugcucccacauaccauuaucgacguacggacuacagaucccguuguggucccuaugccagacgugcgccgaacccuguggcacgaggugcguuccacgacugagccccugaugagacucgucauaauguuauacaccccgaugagggccaacucugggucggaugaagcguuuguugugucaggacggguacugagccgcccugcccccgacuucaacuuuuucuaucuugugccaccuagagucgaggauacaguggaacccuuuaguuugccagaccugaggguugaugagauguccucuagccgguggcagaaucccguggucaugcuacaggcagacccuaaucaaaacaucgcugcccauuggcagaauggucgcuguacuauuaacggcgagcuccuggggaccacaccacgaaaucaguccuggcuucugagaaugaggggaucaguguuggcugccccgggcggucagaaggcaguaaccguuaacguggaucucacggaacccgacgggcaagccuucaguguccugagcggaaacccuggcccagagggcgugcccgacuuucaggcuaucuacaauguccggaugucuacugcguccacaaccgcagggcacacuguggccacaaacggauauauugaacagucagguuacaccccugcuuuaggcacgcugguuauccaagggguggaucucagccagguaccagcccuuggaagugaggucaccaugcaggucguuucuauagaccugaaucauaacauggaucccacacguuugccggacuacaauggcgcagguuucgauggguccguggcccuagcuccuccacuggugcccccucuccccggcgaagugcugcuucgcuuuacuacccugccaauuacaacuagcagaggaucgucuguauccgccaccuuggacugcgcacucccugcggaguggaucacaugguuccuggugcacaacuucguuccccagggcgaugcugccuuacugagguaucggaaucgagggaccggacaaauucuauuugaguguaaacucuacaaggaagguuuccuggcagucgccggcgugucaacucgcacgguguuuccaacaaguggggucuucgaguuuguuagcugggugccgguguucuaucagcuuaccccuguaggauccucuggcgcuagaaaaaggcagcgguga

SEQ ID NO: 18501 - RNA, 1623 nt, Artificial Sequence
  derived and/or modified sequence opt3 from VP1__Norovirus__AIG59994
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaucgggucagcugauuuugccccuaagcugggaagagugcaauucgagaccgacacagaucaugacuuugaagcaaaucagaacacuaaauucaccccaguuggugugauucaggauggcgggacaacucacaggaaugagccccaacaguggguauugccgagcuacaguggacggaacacccacaauguccaucucgccccugcuguggcgccaacauuucccggcgaacagcuguuauucuuucguucuaccaugccugguuguuccggguaucccaacauggaccuggauugccuccuuccacaggaguggguucaauacuucuaucaggaggcagccccugcucagagcgacguggcccuguugcgcuuugucaaucccgauacuggcagagugcuauucgaauguaagcugcacaaaucgggauacguaacgguggcacauacaggccagcacgaccucguuaucccaccgaacggguauuuuagguucgauucuugggucaaccaauucuacacccuggccccuaugggaaaugguacuggccggcgacgcgcuguguga

SEQ ID NO: 18502 - RNA, 1623 nt, Artificial Sequence
  derived and/or modified sequence opt3 from VP1__Norovirus__AIG59996
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccaucuuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacuggaauaacuaugaucccacggaggaaauuccugcuccacuggguacucccgacuucguggggaagauccagggaguccuuacacagaccacucgcacagacggcuccacccgaggccacaaggccacgguguacaccgggucagcugauuuugccccuaagcugggaagaguccaauucgagacagacacugaucaugacuuugaagcaaaucagaacaccaaauucacaccaguggguguuauucaggauggcgggacuacccacaggaaugagccccaacaguggguguugccgagcuacaguggacggaacacacacaauguacaucucgccccugcugucgcgccaaccuuucccggcgaacagcuguuauucuuucguucuacuaugccugguuguuccggguaucccaacauggaccuggauugccuccuuccacaggagugggugcaauacuucuaucaggaggcagccccugcucagagcgacguugcccuguugcgcuuugugaaucccgauacgggcagaguccuauucgaauguaagcugcacaaaucgggauacgugacaguagcacauaccggccagcacgaccucgugaucccaccgaacggguauuuuagguucgauucuuggguuaaccaauucuacacucuggccccuaugggaaaugguaccggccggcgacgcgcugucuga

SEQ ID NO: 18503 - RNA, 1623 nt, Artificial Sequence; identical to SEQ ID NO: 18265
  derived and/or modified sequence opt3 from VP1__Norovirus__AIG59998

SEQ ID NO: 18504 - RNA, 1623 nt, Artificial Sequence
  derived and/or modified sequence opt3 from VP1__Norovirus__AIG60000
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggccaugcggguggguucgaagugcaggucauucuagcaggaaacgccuuuacagcuggcaaagugaucuucgccgcaguaccuccaaauuuuccgacugagggccucucucccucgcagguuacgauguucccucacauuguggucgacgugcgccaacuggagccagugcuuaucccccugccugauguccgaaacaauuuuuaccauuauaaccagucaaaugacccaaccauaaaguugaucgcuaugcucuacacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccacaucacaggcagccggaacuauaccaugaaucucgcaucucagaacuggaauaacuacgaucccacggaggaaauaccugcuccacuggguacucccgacuucgucgggaagauucagggagugcuuacacagaccacucgcacagacggcuccacccgaggccauaaggccacggucuauaccgggucagcugauuuugccccuaagcugggaagagugcaauucgagacagacacugaucacgacuuugaagcaaaucagaacaccaaauucacaccaguuggugugauccaggauggcgggacuacccacaggaaugagccccaacaguggguauugccgagcuacaguggacggaacacacauaauguccaccucgccccugcuguggcgccaaccuuucccggcgaacagcuguuauucuuucguucuacuaugccugguuguuccggguaccccaacauggaccuggauugccuccuuccacaggaguggguucaauauuucuaccaggaggcagccccugcucagagcgacguggcccuguugcgcuuugucaaucccgauacgggcagagugcuauucgaauguaagcugcauaaaucgggauauguaacaguggcacacaccggccagcacgaccucguuauuccaccgaacggguacuuuagguucgauucuugggucaaccaauucuauacucuggccccuaugggaaaugguaccggccggcgacgcgcuguguga

SEQ ID NO: 18505 - RNA, 1623 nt, Artificial Sequence
  derived and/or modified sequence opt3 from VP1__Norovirus__AIG60002
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagcagugacccauaucacaggcagccggaacuacaccaugaaucucgcuucucagaacugguccaauuaugaccccacggaggaaauaccugccccacuggguacucccgauuucgucgggaagauucagggagugcuuacacagaccacucgcacagacggcucaacccgaggccacaaggcuacggucuacaccgggagcgccgacuuugcaccuaagcugggaagagugcaauucgagacagauacugacagggauuuugaagccaaccagaauaccaaauucacaccaguuggugugauccaggacggcaguacuacccaucggaacgagccccaacaguggguauugccgucuuacuccgggcguaauacaccuaacguccaccucgcuccagcgguggcacccaccuuuccuggagaacagcuguuauucuuucgcagcauuaugcccggcuguucggguuauccaaauauggaucuggacugccuccuuccucaggaguggguucaauacuucuaucaggaggccgcucccgcccagucugauguggcacuguugagauuugucaacccagacacugggagggugcuauucgaauguaagcugcacaaauccggcuacguaacgguggcccauacaggacagcacgaucucguuaucccgccuaauggcuauuuucgguucgacucaugggucaaccaauucuacacccuggcucccauggggaacggaacuggucgacgcagagcccuuuga

SEQ ID NO: 18506 - RNA, 1623 nt, Artificial Sequence; identical to SEQ ID NO: 18265
  derived and/or modified sequence opt3 from VP1__Norovirus__AIG60004

SEQ ID NO: 18507 - RNA, 1623 nt, Artificial Sequence; identical to SEQ ID NO: 18265
  derived and/or modified sequence opt3 from VP1__Norovirus__AIG60006

SEQ ID NO: 18508 - RNA, 1623 nt, Artificial Sequence
  derived and/or modified sequence opt3 from VP1__Norovirus__AIG60008
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggaccuggauugccuccuuccucaggaguggguucaauacuucuaucaggaggcagcccccgcucagucggacguggcccuguugcgcuuugucaacccagauacgggcagagugcuauucgaauguaagcugcauaaaucuggauacguaacaguggcacacaccggccagcaugaccucguuauuccgccuaauggguauuuuagguucgauuccugggucaaccaauucuacacucuggcccccaugggaaacgguaccggccggcgacgcgcucuuuga

SEQ ID NO: 18509 - RNA, 1623 nt, Artificial Sequence; identical to SEQ ID NO: 18319
  derived and/or modified sequence opt3 from VP1__Norovirus__AIG60010

SEQ ID NO: 18510 - RNA, 1623 nt, Artificial Sequence; identical to SEQ ID NO: 18265
  derived and/or modified sequence opt3 from VP1__Norovirus__AIG60012

SEQ ID NO: 18511 - RNA, 1623 nt, Artificial Sequence
  derived and/or modified sequence opt3 from VP1__Norovirus__AIG60014
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcagcacuacccacaggaaugagccccaacaguggguauugccgaguuacucugggcggaacacacacaauguccaucucgccccugcuguggcgccaaccuuucccggagaacagcuguuauucuuucguuccacuaugccuggcuguagcgguuaucccaacauggaccuggauugccuccuuccacaggaguggguucaauacuucuaucaggaggcagccccugcucagucggacguggcccuguugcgcuuugucaaucccgauacggggagagugcuauucgaauguaagcugcacaaaucuggcuacguaacaguggcacauaccggacagcacgaccucguuauuccaccgaacggcuauuuuagguucgauuccugggucaaccaauucuacacucuggccccuauggggaauggaaccggucggcgacgcgcuguguga

SEQ ID NO: 18512 - RNA, 1623 nt, Artificial Sequence; identical to SEQ ID NO: 18313
  derived and/or modified sequence opt3 from VP1__Norovirus__AIG60016

SEQ ID NO: 18513 - RNA, 1623 nt, Artificial Sequence; identical to SEQ ID NO: 18265
  derived and/or modified sequence opt3 from VP1__Norovirus__AIG60018

SEQ ID NO: 18514 - RNA, 1623 nt, Artificial Sequence
  derived and/or modified sequence opt3 from VP1__Norovirus__AIG60020
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaaucgugcaauucgagacagacacugaucaugacuuugaagcaaaccagaauaccaaauucacaccaguuggugugauucaggauggcaguacuacccacagaaacgagccccaacaguggguauugccgucuuacuccgggaggaauacaccuaacguccaccucgccccagcuguggcgcccaccuuuccuggagaacagcuguuauucuuucggagcacuaugcccggcuguucggguuauccaaauauggaccuggauugccuccuuccucaggaguggguucaauacuucuaucaggaggcagcccccgcucagucugacguggcccuguugcguuuugucaacccagauacggggcgcgugcuauucgaauguaagcugcauaaauccggcuacguaacaguggcacacaccggacagcaugaccucguuaucccgccuaauggcuauuuuagauucgauucaugggucaaccaauucuacacucuggcccccauggggaacggaaccgguaggcggcgagcucuuuga

SEQ ID NO: 18515 - RNA, 1623 nt, Artificial Sequence; identical to SEQ ID NO: 18265
  derived and/or modified sequence opt3 from VP1__Norovirus__AIG60022

SEQ ID NO: 18516 - RNA, 1623 nt, Artificial Sequence; identical to SEQ ID NO: 18319
  derived and/or modified sequence opt3 from VP1__Norovirus__AIG60024

SEQ ID NO: 18517 - RNA, 1629 nt, Artificial Sequence
  derived and/or modified sequence opt3 from VP1__Norovirus__AII73717
augaagauggccagcaacgacgcugcacccuccaaugauggcgccgcgucucuggugccugaggggauuaacgaaaccaugccacucgagccggucgcuggagccucaauugcagcccccguugcuggucagacaaauauaaucgacccuuggauuagaacuaacuucgugcaagcaccaaauggcgaauuuacgguaagucccaggaacagcccuggggagauccuucugaauuuggaauuaggaccagaucugaaccccuaccuagcccaccucucccggauguauaauggcuacgcuggugggguggagguccaggugcugcuugccggaaacgcguucaccgcaggcaaaauucuguuugccgcuaucccuccaaauuucccgguugacaugauaucucccgcccagaucacaauguugccucaucucauuguggauguccgcacucuggagccaaucaugauuccccugccugacgugcgaaacguauuuuaucacuucaauaaccagccacaaccccguaugagacucguugcaauguuauacaccccgcugaggucgaauggcucaggggaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgcuccaaacgagacaaauguugugcagugucagaacggaaggugcacucuugacggugaacugcaaggcaccacacaguugcucuccucagccguauguaguuaucgggggcgcaccguggcgaauaacggagauaauugggaccagaaccuguuacagcugacguacccgaauggcgccagcuacgaucccacugacgaggucccugcaccacucgguacacaagacuucucugggaugcuuuauggagugcugacccaggauaacguuaauguguccacuggcgaagcuaagaacgccaaaggcaucuacaucucaacaaccagcgggaaguuuacgcccaagauuggaaguauagguuugcauucuaucaccgagcacguccauccuaaucagcaaucccgauucacaccagugggcguagcuguuaacgaaaauacucccuuccagcagugggugcuaccgcacuaugccgggagccuggcacucaacaccaaucuggccccugcugucgcgccaacauuucccggagagcagcuucuguucuuuagaucgagggugccuugcguccaaggcuugcagggucaggacgcauucauugauugucuccugccccaggagugggugaaccacuuuuaccaagaagccgcuccaucucaggccgacguugcauuaauccgguaugugaacccugauacugggcguacccuguucgaggccaaacuacaucgcuccggcuuuauaacaguaucacacaccggagcuuacccccucgucgugccaccgaauggccauuucagauuugacaguuggguuaaccaguucuauagccuggccccuauggggacuggaaaugguaggcggcgaauccaguga

SEQ ID NO: 18518 - RNA, 1623 nt, Artificial Sequence
  derived and/or modified sequence opt3 from VP1__Norovirus__AII73720
augaagauggccagcaacgacgcuacccccuccaaugauggcgcagccgggcuggugccugagucuaacaaugaagcgauggcucucgagccagucguuggagccucacuugcagccccggugacaggucagacuaacaucauugaccccuggauaagaacgaauuucguacaagcuccuaacggcgaauuuaccgugaguccaaggaauagccccggggagauccuggucaacuuggaauuaggaccugagcugaauccauaccuagcacaccucgcccggauguauaacggcuacgcuggugggauggaggugcagguuaugcuggccggaaaugcguucacagcaggcaaaauuaucuuugccgcugugcccccuuauuucccagucgaaaaccuuuccccgucucagauuacuauguuuccccaugugaucguagauguucgcacccuggagccuguguugcucccaaugcccgacguccgaucgacacuguuccacuuuaaucagaaggaugaaccuaaaaugcgucugguggccaugcucuacaccccauuaagaucaaacggcagcggggacgauguguucacugucaguugcaggauacugacacggcccuccccggaguuugacuucaccuaucuuguuccucccacgguggagucuaagacuaaaccauuuaccuugccuguacugacacuaggagaacucagcaauucccgcuucccccugucaaucgaugagauggugacuagcccaaacgaaagcauugucgugcaaccccagaacgguagaguuacccuugacggcgagcuguuggggacaacccagcuccaggcauguaauaucugcucuauuaggggaaaggugacgggccaagucccuaacgaacagcauauguggaaucuggagaucacuaacuuaaaugguacacaguuugauccaaccgacgaugugccggcuccccuggggguaccugacuucgccggagagguuuucggcgugcucucccagcggaaccgcggcgaaucaaauccagcgaaccgagcccacgacgcagucguggcuacuuacagcgauaaguauacacccaaacuugggcugguccaaauaggaaccuggaauacgaacgacguggagaaucagccuaccaaguuuacaccaauugguuugaacgaaguugccaauggccauagauucgagcaguggacucuacccagguacaguggggcucugacccucaacaugaaucuggccccggcaguggccccucuuuuuccaggagaacggcuguuguucuuucguucuuacguaccccucaaaggcgguuucgggaacccugcuaucgauugucuggucccccaagagugggugcagcacuuuuaucaggaguccgcgccaaguuuaggcgacguugcacuggugcgcuacgucaacccugauacaggaagagugcuauucgaagccaagcuccacaaaggcggguuucugacuguaucgucuaccuccacaggacccgugguugucccagcuaaugguuauuucagguuugacucaugggugaaccaguucuacagucuugccccgaugggcaccgggaauggacggcgacgcuuucaauga

SEQ ID NO: 18519 - RNA, 1611 nt, Artificial Sequence
  derived and/or modified sequence opt3 from VP1__Norovirus__AII73723
augaagauggccagcaacgacgcuacccccuccgaugacggcgcagccgggcuggugccugagaucaauucugaagucauggcgcucgagccaguugcuggagccucaauugcagccccggugguaggucagcaaaacauaaucgaucccuggauuagaaauaacuucgugcaggcuccugcaggcgaauuuacagucaguccaaggaauagccccggggagcuucuguuggacuuagaacugggaccugagcuaaacccauaccucgcccaccuggcucggauguauaauggccaugccggugggauggaggugcagaucguucuugcgggaaacgcauucacugccggcaaaauucuguuugcugccauacccccuuccuucccauacgaaaauuugucuccggcacagcucacgaugugcccccacgugaucgucgaugugcgccaacuggagccuguacugcucccaaugcccgacauccgaaacguguuuuaucauuacaaucagaacaauucgccuaaguuacgucugguugcuaugcuuuauaccccauugagagccaacaauucaggcgaugacgucuucacagugagcuguagggugcugacucggcccaguccggauuuucaguucaccuuucuagucccucccacaguugaauccaaaaccaagaacuucacucucccagugcugcgcguaucugagaugacaaacagcagauuuccugugguccuugaccagauguacaccuccaggaaugagaacauuaucgugcaaccccagaaugggcggugcacgacugauggagaacuguuggguaccacaauucuccagucaguuaguaucuguaacuucaaaggcacuaugcaggcgaagcugaaugaggaaccacgcuaucaauuacagcugaccaaccucgacgggagccccauagauccuacagacgacaugccagccccgcuuggaacccccgauuuucaggcagugcuguacggcgucgcuucucaacgauccucaagagacaaugccacgagggcucacgaugcccagauugacacugcaggggauacauucgccccuaagaucggucaggugcgguucaaaagcaguucuaacgacuuugauuugcaugacccaaccaaguucacucccauuggaguaaauguugaugaccagcacccuuuucgucaauggucccuaccaaacuacggcggccaccuggcucucaauaaccaucuggcgcccgcagugacaccgcuuuucccuggggagcagauccuguuuuuccgcagcuauaucccaucggccggaggucacaccgauggcgcuauggacugcuugcucccccaggaaugggucgagcauuuuuaccaggaggccgcaccuucucaauccgacauugcccuggugagauucauaaaucccgauacggggagggucuuauuugaagcuaaacugcacaagcagggauuccuaaccaucgccgcaucaggcgaccacccaauugugaugccuacaaacgguuauuuucgguucgaggcguggguuaaucccuuuuacacucucgcuccaguggggaccggcaguggacgacgcagaauccaguga

SEQ ID NO: 18520 - RNA, 1623 nt, Artificial Sequence; identical to SEQ ID NO: 18265
  derived and/or modified sequence opt3 from VP1__Norovirus__AII73726

SEQ ID NO: 18521 - RNA, 1623 nt, Artificial Sequence; identical to SEQ ID NO: 18265
  derived and/or modified sequence opt3 from VP1__Norovirus__AII73729

SEQ ID NO: 18522 - RNA, 1623 nt, Artificial Sequence; identical to SEQ ID NO: 18265
  derived and/or modified sequence opt3 from VP1__Norovirus__AII73732

SEQ ID NO: 18523 - RNA, 1608 nt, Artificial Sequence
  derived and/or modified sequence opt3 from VP1__Norovirus__AII73735
augaagauggccagcuccgacgcugcacccucuaacgauggcgccgcggggcuggugccugaggcuaauaacgaaaccauggcccucgagccagucgcaggagccucaaucgcugcaccgcuuacaggucagaauaacauuauagaccccuggaucagacugaauuucguucaagccccuaacggcgaauuuacugugaguccaaggaauagccccggggagguauuguuaaaccuggaacuaggaccugagcucaauccauaccuggcucaccuuucccggauguauaacggcuacgccggugggguggagguccaggugcuguuggcgggaaaugcauucacggccggcaaacucguuuuugcugccgugcccccucauuucccacuggaaaacauuucuccgggccagaucaccauguuuccccacgucauuaucgaugugcgcacacuggagccuguacucuuaccacugcccgacguucgaaauaacuucuuucauuauaaucagcaaaacgaaccucguaugagacuuguggcaauguuguacacuccacugaggucgaacgggucaggagaugacgucuucaccgugagcugccgggugcuaacacgccccaguccggauuuugacuucaauuaucucgucccucccaccguugaguccaagacuaaaccauuuacacugccuauacuuaccaucggugagcugacgaacucuagauuccccgugccaauugaugaauuguacacuagccccaaugagucccucguagugcagccucagaacgggaggugugcucuggacggcgaauuacagggaaccacacaacugcucccaacugccaucugcucauuucggggccgcauuaaucagaaggucaguggugagaaccacguguggaauaugcagguuaccaacaucaaugggacaccguucgaucccaccgaagacgugccugcgccacuuggaacgcccgauuucagcggcaaacuguuuggcgucuugucuccucgagaccaugacaacgccuguagaucccacgaugcagugauagcuacuaauucagccaaguucacaccaaagcuaggggcuauucagaucggaaccugggaggagaacgacguacacauuaaucaacccacuaaauuuacaccgguuggucuguucgaagaugagggcuuuaaccaguggacccucccuaauuauagcggggcccugacgcuuaacaugggacuggcaccacccguggccccuaccuuccccggcgaacagaucuuguuuuucaggagucauaucccacucaaggguggggucgcugacccugugauugauugccuguuaccccaagaguggauacagcaccuguaccaggaaucugcgccaucccagagcgacgucgcacuaauccgguuuacaaacccggauacuggccguguucucuucgaggccaaacugcaucgcucgggauacauuaccguggcuaauacaggcucuagaccuaucgugguacccgccaacggguauuuuagguucgacuccugggucaaucaauuuuacucacuugcaccaaugggaacugguaacggccggcgacgcgugcaguga

SEQ ID NO: 18524 - RNA, 1623 nt, Artificial Sequence; identical to SEQ ID NO: 18319
  derived and/or modified sequence opt3 from VP1__Norovirus__AII73738

SEQ ID NO: 18525 - RNA, 1620 nt, Artificial Sequence
  derived and/or modified sequence opt3 from VP1__Norovirus__AII73741
augaagauggccagcaacgacgcugcacccuccaaugauggcgccaccgggcuggugccugagaucaacacagaaacucucccacuugagccggucgcgggagcugccauugcagcccccguuacgggucagaauaacauaaucgacccuuggauuagaaauaacuucgugcaagcuccaaauggcgaauuuaccguaucucccaggaacucaccuggggagauccugaugaauuuggaauuaggaccagaucugaaccccuaccuagcacaccucagucggauguauaauggcuacgccggugggguggagguccaggugcugcuugcuggaaacgccuucacagcgggcaaaauucuguuugcagccguuccuccaaauuucccgguggacauguugagccccgcucagaucacuaugcucccucaucugauagucgaugugcgcacccuggagccaaucaugauuccccucccugacguacgaaacguguuuuaucacuucaauaaccagccagcaccccguaugagauuaguugccaugcuguacacaccgcuuagguccaacggcucuggggaugacgucuuuaccgugucgugccggguguugacucgcccuacacccgauuucgaauuuaccuaucuggucccaccuucaguugagagcaagacgaaacccuucacucuaccaauccucaccauuggagaacugacaaauaguagauuucccgcuccuaucgaccaacuuuacacuuccccaaacgccgauauagugguacagccgcagaaugguagguguacccuggacggcgaguugcaggggacaacccaacuccugacgacugcgauuugcucuuaucggggaaugacaagcaaccccaccuccgauuacugggacgaccauuuacugcaccucgugcauccuaauggcgccacuuacgauccaacagaggacguccccgcaccuuucgguacccaggauuuucgcgggauccuuuauggaaugcugacgcagaacccacgaaccucaggcgacgaagcugccaauagucacggcauuuacaucagcucuacauccgagaaguucacucccaaauuggggaccaucggacuacaccaggugcaaggugauauugcuucaaaccagcagagcaaguucacaccgguuggcauagccgugaaugggaacacuccuuuuagacaaugggaacugccaaauuauaguggagcacucacccugaacacaaaucuugcccccgcugucggcccuaacuuccccggugagcagauccuguuuuucaggucuaaugugccauccguacaagggggccagccuauugaaaucgacuguuugauaccccaggaguggguuagccauuuuuaccaggagucggcgccaucucaguccgauguggcacucguccgguaugugaacccggacaccggacguacuauuuucgaagccaagcugcaccgccagggcuuuaucacgaucgcugccacagggucaaacccugucgugguucccccaaauggauacuucagauuugauaguugggugaaccaauucuaugcauuagcccccauggguaccggcaaugggaggcggcgaguacaguga

SEQ ID NO: 18526 - RNA, 1623 nt, Artificial Sequence; identical to SEQ ID NO: 17662
  derived and/or modified sequence opt3 from VP1__Norovirus__AII73744

SEQ ID NO: 18527 - RNA, 1623 nt, Artificial Sequence
  derived and/or modified sequence opt3 from VP1__Norovirus__AII73747
augaagauggccagcaacgacgcugcacccuccaaugauggcgccaccgggcuggugccugagaucaacaaugaaacacucccacuugagccggucgcgggagcugccauugcagcccccguuacuggucagaacaauauaaucgacccuuggauuagaacgaacuucgugcaagcuccaaauggcgaauuuaccguaucucccaggaacucaccuggggagauccuguugaauuuagaacugggaccagaucuaaaccccuaccucgcacaccugagucggauguauaauggcuacgccggugggguggagguccaggugcuucuggcuggaaacgccuucacagcgggcaagauuuuguuugcagccguuccuccaaauuucccgguggaguuucucagccccgcucagaucacuaugcugccucaucugauagucgacgugcgcacccucgaaccaaucaugauucccuuaccugauguacgaaacacauucuuucacuauaauaaccagccagccaaccguaugagacugguugcaaugcuuuacacccccuugagguccaauggcucuggggacgauguguucacugucucgugccgggugcugacacgcccgaccccugacuuugaguucacguaucuagugcccccaucagucgaaagcaagacuaaaccuuuuagucuccccauccugaccauuuccgagcuuacaaacucuagauucccagcucccaucgauagccuguuuacugcccaaaauaacaauuugaacguucagugucagaauggaaggugcacccucgacggugagcugcagggcacaacccaauuacugccuuccgggauaugugcguuccggggacgccucacggccgauguggacggcucacaugaugaccgauggcacaugcagcuuacuaaccugaaugguacaccauucgacccgaccgaagauguacccgcaccuuuggggacuccagacuuuacaggacuacuguucggcguggcuagucagagaaacgucggcagcaaucccaacaccacgagggcccaugaggcugugauuucuaccacauccucacaguuuguuccuaagcucgggagcgugaauuucggaaguacuucuaccgauuuucaacugcagcagccaacaaaauucacucccgucgguaucaagauugaauccggccacgaguuugaccaaugggcccuuccgcgguacagcgggcaccugaccuugaacaugaaucucgcaccuccaaucgcccccaacuucccuggagaacagcuguuauuuuuccguucgaacgugcccugcgcuggcgguguaucugaugggguuaucgacugucugcuaccacaggaguggauucagcauuuuuaucaagaguccgcgccuucacagagugauguggcacucauacgcuacgucaaucccgacacaggcagaacccuguucgaagccaaacuucacaggacuggauacaucacgguggcucauagcggcgauuauccauuggucgugccguccaacggguacuuucgguucgacucuuggguuaaucaguucuauagccuggccccuaugggaacagguaacggccgacgcagagugcaguga

SEQ ID NO: 18528 - RNA, 1623 nt, Artificial Sequence
  derived and/or modified sequence opt3 from VP1__Norovirus__AII73750
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggccaugccgguggguucgaagugcaggucauucuagcgggaaacgcauuuacugccggcaaaaucauuuucgcugccgugccuccaaauuuuccgacggagggccucucucccucgcagguaaccauguucccucacaucauaguugacgugcgccaacuggagccaguccuuaucccccugccugaugugcgaaacaauuuuuaccauuauaaccagucaaaugacagcacaauuaaguugaucgcaaugcucuacacuccacugcgugcuaacaacgccggggaagauguguucaccgucaguugcagaguucugacaaggcccuccccggacuuugauuucauuuuucucgugccucccaccguagagucucggacuaaaccauucacagugccuaucuuaaccgucgaagagaugacgaauagccgcuuucccauaccacuggagaaacuuuucacuggacccuccucagcguucgugguucagccucagaacgguagauguaccacagacggcguguugcuggggacuacccaacuaaguccagucaauauuugcacauuuaggggagaugugacccacaucgccggcagccggaacuauacgaugaaucucgcaucucugaacuggaauaacuacgacccgacugaagagauucccgcuccucuugguacaccagauuucguagggaagauccagggaguucugacccagacuacaaagggcgacggcuccacccgcgggcauaaggccacgguguauaccggaucagcucccuuuacaccuaaauuggguagcguccaguucaguacugacaccgaaaaugauuuugagacacaccaaaacacuaaguucaccccagugggcgucauccaggacgggggaacaacccaccgaaaugaaccccagcaaugggugcucccgucuuacuccggcagaaacguucauaaugugcaccuggccccugcaguagccccaacuuuucccggugagcaguuacuguucuuuaggagcacgaugccuggguguucgggcuaccccaacauggaucucgacugccuucugccacaggaguggguccagcauuucuaucaagaagcugcgccugcacagucugauguggccuugcuacgguuuguuaaucccgacacaggacgugugcuguucgaguguaaacuccacaaguccggcuacgucaccguggcucacacugggcagcaugaucugguaauuccaccgaacggauauuuucgcuucgacucaugggugaaccaguucuacacccuugccccuauggguaauggcacagggagaaggcgggcacuguga

SEQ ID NO: 18529 - RNA, 1623 nt, Artificial Sequence
  derived and/or modified sequence opt3 from VP1__Norovirus__AII73753
augaagauggccagcaacgacgcuacccccuccaaugauggcgcagccgggcuggugccugagucuaacaaugaagcgauggcucucgagccagucguuggagccucacuugcagccccggugacaggucagacuaacaucauugaccccuggauaagaacgaauuucguacaagcuccuaacggcgaauuuaccgugaguccaaggaauagccccggggagauccuggucaacuuggaauuaggaccugagcugaauccauaccuagcacaccucgcccggauguauaacggcuacgcuggugggauggaggugcagguuaugcuggccggaaaugcguucacagcaggcaaaauuaucuuugccgcugugcccccuuauuucccagucgaaaaccuuuccccgucucagauuacuauguuuccccaugugaucauagauguacgcacccuggagccuguuuugcucccaaugcccgacgugcgaucgacacuguuccacuuuaaucagaaggaugaaccuaaaaugcgucuggucgccaugcucuacaccccauuaagaucaaacggcagcggggacgauguguucacugugaguugcaggauccugacacggcccuccccggaguuugacuucaccuaucuugucccucccacgguugagucuaagacuaaaccauuuaccuugccugugcugacacuaggagaacucagcaauucccgcuucccccugucaauugaugagaugguaacuagcccaaacgaaagcaucgugguccaaccccagaacgguagagugacccuugacggcgagcuguuggggacaacccagcuccaggcauguaauauuugcucuaucaggggaaagguuacgggccaagugccuaacgaacagcauauguggaaucugcagauaacuaacuuaaaugguacacaguuugauccaaccgacgaugucccggcuccccugggggugccugacuucgccggagagguauucggcguucucucccaacggaaccgcggcgagucaaauccagcgaaccgagcccacgacgcaguggucgcuacuuacagcgauaaguauacacccaaacuugggcuggugcagauuggaaccuggaauacgaacgacgucgaaaaucagccuaccaaguuuacaccaaucgguuugaacgagguggccaauggccauagauucgaacaauggacucuacccagguacaguggggcucugacccucaacaugaaucuggccccggcaguugccccucuuuuuccaggagagcggcuguuguucuuucguucuuacgugccccucaaaggcgguuucgggaacccugcuauugauugucugguaccccaggaauggguccagcacuuuuaucaggaguccgcgccaaguuuaggcgacguggcacugguucgcuacgugaacccugauacaggaagaguccuauucgaggccaagcuccacaaaggcggguuucugacugugucgucuaccuccacaggacccguagugguuccagcuaaugguuauuucagguuugacucaugggucaaccaauucuacagucuugccccgaugggcaccgggaauggacggcgacgcuuucaguga

SEQ ID NO: 18530 - RNA, 1623 nt, Artificial Sequence; identical to SEQ ID NO: 17662
  derived and/or modified sequence opt3 from VP1__Norovirus__AII73756

SEQ ID NO: 18531 - RNA, 1668 nt, Artificial Sequence
  derived and/or modified sequence opt3 from VP1__Norovirus__AII73759
augagaauggccagcuccgacgcucccgugucuggcaccgauggggcagccggacuggucccugagucacagcaagaaguucucccacuugagccgguggcggguguacagcuggcugcccccguggcaggccagaguaacaucauugacccuuggauaaggaugaauuucguccaggccccagcuggggaauuuacagugagcccccggaacgcaccuggagagguuuugaucgauuuagaacugggcccagagcuaaaucccuaccucaaccaccuggcccgcauguauaaugguuacgucgggggaauggagguggaagugguacuugcuggcaacgccuucacugcgggcaagauucuguuugcagccguuccuccauccuucccgacgcaugggaucucugcugcccaagcaaccauguugccccacgugauugucgacgugcgacagcucgagccugugcgucugccacugcccgaugucagaaauguuauguuucauuucugccaggaaaacaaggagccuaggaugcggaucguggcuauacucuauacaccauuacgcgccaauggagcgggugacgauguauuuacugugucguguagaguccugaccaggcccucaccggacuucgauuuuaucuuccuugugccucccagcguugagaguaaguugaaacaguuuacacugccaaaccuacaaccuaaugaaaugaccaacucccgguuccccacuggcauuacacagcucuacaccucuccaaauacgaaccuggugguccaguuucagaaugggcgcugccuucuggacggaacuuugcucggcaccacacccgugcgagccgcagauaucuguagcuucagagguguaacuuccaccgagguugacgcuacagauucaccuaggguggccgggagucaccggauuaugguccaacugcgugaaccagacggagaggaguucagcccgaccggccccaacccugcuccagugggcacgcccgacuuucaggccgcaaucuucgggacuuuaucucagcgcaacacaggaggugccggccaaaauuccaacagagcucauuuugcguauuucuacaccaggaauccuacuuuugcaccagggauaggaacagucguguucucauuugauaccacggacuuccagaaccggcagcccaccaaguuuagcccgaguggcguuuucgaugacgauucuuccgaaccuuuuaaucaguucagccugccauauuacaacgguucgcucggggccguggacgcuggcaaacuugcacccccuguagcccccaauuacccaggagagcaaauucuguauuuucgaggcucugucccuuucaaagggggauacggugaaggcgagaucgauuccuugcuaccccaggaauggauuacacacuucuaugccgagcaggcuccaacucagggggacgccgcacugcuccgcuacuauaacccggauaccggaagagugcuguuugaaugcaaacuucacagggagggcuucaucacaaucaauuacacugguucaaacgcgcuggcuguuccugugaauggggucuuucgguucgagggcugggugaacaaguuuuauaccuugacacccaugggaaauggcaacgggcgcagaggaaggcgucgggaacucuga

SEQ ID NO: 18532 - RNA, 1668 nt, Artificial Sequence
  derived and/or modified sequence opt3 from VP1__Norovirus__AII73762
augaagauggccagcaaagacgcuucccccucuaccgauggcacagcaaaccuggugccugagucacagcaagaaguccucgcccuucagccaguugcgggggcucagaucgccgcaccgguggccggacaguucaauguaauugaccccuggauauaccaaaacuuugugcaggcuccugagggugaguucacugucaguccaagaaauagcacgggcgaaauccugaugaacuuggaauuagggccccagcugaauccuuaucuagcacaccucgccaggauguacaacgcuuaugccggaggcuuugaggugcagguucugcuugcggguaaugcauucaccgccgggaagauuaucgugugcgcugucccacccaacuuuccucugcaaaauauuuccgccgcacaggcuacacaguugccacaugugguaguugaugugcggcagcucgagccggucgugcugccccugccugacgugcgcgccggauucuaccacuauaaccaagucgaagagucucgaaugcgucucguugcgaucuuauacacuccacugagaaccaauucggccggcgaugacgcauuuacagugucauguaggauacuuacccggcccgcuccugauuucagcuuuuucuuuuugaucccacccacuauugaaaguaaaacaaccccguucacgcugccucgccuacccaucuccgagaugacuaacucuagauuuccacucguaauuaagggcaugguggucgacccuaaucugccccuucaggccaacuuccagaaugggaggaucacccuggauggagaguugcaagguacaacucucccaaccagcacauccauaggccggauuucagggacccauaugaguagcacgcccucucgcaucauucagcacgaagacuccggagauucaacucagccucgaguguucaacccaguuuggauggaccugacagagaacaauuggaccgaauuucagccguucaacgaucaacccgcuccuuuaggcugcccagacuuuaaagccaagauccuggguacucucaucagacagcccaauaacgggagcuauuacuucgacgcauaccuugauacaaggcagcauggaaccuuugccccuuauacgggccacgcugcggugcacagugaccagcaagcaggccaucuggcccagggguacaagauucaguucucuccaaccggaauagaguccgaucagaauacagacuugaaccaacuacccgauuaugguggcgcuaugacugucagcaaagggcuggccccggcagccgcuccugacuuuccaggagaaaugauccucuacuucgugucggauaugcccguacggaauccuaacggcgagcgucgcgacaccgagauucugugucuucugccccaggaaaugguuacacacuuuuaugagcagcaggccccaucucaaggugauguggcauuggucagauacaucaaugcggaaacugggagggugauguucgagggcaagcuccaucggaacggauuuuucaccgucuccgcuacagcccgaacccugauagugccugacggcuauuuucgcuucgauucauggguuaauagauucuacacuuuaagucccauggggacgggaaacgguaggcggcgcgcaagaaugcuggaauga

SEQ ID NO: 18533 - RNA, 1638 nt, Artificial Sequence
  derived and/or modified sequence opt3 from VP1__Norovirus__AII73765
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauauucucuuugaccuucagcugggcccucacuugaauccauucuuaagucaucuggcccaaauguauaacgguuggguagggaauaugaaagugaagguccuacucgcgggaaacgcauuuaccgccggcaaaaucauuaucagcugcauacccccuggcuucguggcucagaauguuuccaucgcccaggcaacaauguuuccacacgugauugcugaugucagagugcuggaaccgaucgaaguaccccuugaggacguuaggaacgugcuguuccauaauaacgauaauaccccuacuaugcgguuggucuguaugcucuacacaccacugcgcgccucugggucgucaagcggaaccgaccccuuugugauugcgggucgagugcugacgugcccuaguccagauuucuccuuucucuucuuaguucccccgaacgucgagcagaagacuaaaccuuuuucugugcccaaccugccacuuaauaccuugagcaacucccguguaccuucacugaucaagaguaugauggugagcagagaccacggccaaaugguccaguuccagaaugggagggugacacuagauggacagcuccaaggcacuacccccacaucugccucccagcuguguaagauacgggguucaguuuuucaugcaaacgggggaaauggcuauaaccuuaccgaacuggacggcagcccauaccacgcuuucgagagucccgccccuauuggguucccagauuugggagaaugcgacuggcacauggaggcuucuccgacgacucaguuuaauacaggugacgugaucaaacaaauuaacgucaagcaggaguccgccuucgcaccccaucucggcaccauccaggccgaugggcugagcgacgugucgguaaauacuaacaugaucgcuaaauuaggauggguuucuccuguguccgauggccacaagggugacgucgauccaugggugauuccccgcuaugggucaacacugaccgaagcggcacagcucgccccuccaauauaucccccgggcuuuggagaggcuaucgucuucuuuaugagugacuucccuauugcccauggcacgaaugggcuuagcgugccauguaccaucccccaagaauuuguuacacacuucgugaacgagcaggcaccuacuagaggagaagccgcucuguugcacuaccuagaucccgacacccauaggaaucugggugaguuuaaacucuacccagauggcuucaugacaugcguaccuaacuccucugggacuggaccccagacccugccaauaaauggcgucuuuguguucguuagcugggugucacgguuuuaccagcuuaagccggucgguacagccgggccugcacgccgacugggcauuagaaggaguuga

SEQ ID NO: 18534 - RNA, 1623 nt, Artificial Sequence; identical to SEQ ID NO: 18265
  derived and/or modified sequence opt3 from VP1__Norovirus__AII73768

SEQ ID NO: 18535 - RNA, 1608 nt, Artificial Sequence
  derived and/or modified sequence opt3 from VP1__Norovirus__AII73771
augaagauggccagcuccgacgcugcacccucuaacgauggcgccgcggggcuggugccugaggcuaauaacgaaaccauggcccucgagccagucgcaggagccucaaucgcugcaccgcuuacaggucagaauaacauuauagaccccuggaucagacugaauuucguucaagccccuaacggcgaauuuacugugaguccaaggaauagccccggggagguauuguuaaaccuggaacuaggaccugagcucaauccauaccuggcucaccuuucccggauguauaacggcuacgccggugggguggagguccaggugcuguuggcgggaaaugcauucacggccggcauucucguuuuugcugccgugcccccucauuucccacuggaaaacaucucuccgggccagauuaccauguuuccccacgucaucauagaugugcgcacacuggagccuguacucuuaccacugcccgacguucgaaauaacuucuuucauuauaaucagcaaaacgaaccucguaugagacuuguggcaauguuguacacuccacugaggucgaacgggucaggagaugacgucuucaccgugagcugccgggugcuaacacgccccaguccggauuuugacuucaauuaucucgucccucccaccguugaguccaaaacuaagccauuuacacugccuauccuuaccauuggugagcugacgaacucuagauuccccgugccaaucgaugaauuguacacuagccccaaugagucccucguagugcagccucagaacgggaggugugcucuggacggcgaauuacagggaaccacacaacugcucccaacugccauuugcucauuucggggccgcaucaaucagaaagucaguggugagaaccacguguggaauaugcagguuaccaacauaaaugggacaccguucgaucccaccgaagacgugccugcgccacuuggaacgcccgauuucagcggcaagcuguuuggcgucuugucucagcgagaccaugacaacgccuguagaucccacgaugcagugauugcuacuaauucagccaaauucacaccuaagcuaggggcuauccaaauuggaaccugggagcaggacgauguacacaucaaccagccaacuaaguuuacacccguuggucuguucgagaaugaaggcuuuaaccaauggacccucccgaauuauagcggggcccugacgcuuaacaugggacuggcaccuccaguggcccccaccuucccuggcgagcagaucuuguuuuucaggagucauauuccccucaaagguggggucgcugacccagugauagauugccuguuaccucaggaauggauccagcaccuguaccaagagucugcgcccucccagagcgacgucgcacuaauucgguuuacaaacccagauacuggccguguucucuucgaagccaagcugcaucgcucgggauacaucaccguggcuaauacaggcucuagaccgauagugguaccugccaacggguauuuuagguucgacuccugggucaaucaguuuuacucacuugcacccaugggaacugguaacggccggcgacgcgugcaguga

SEQ ID NO: 18536 - RNA, 1623 nt, Artificial Sequence
  derived and/or modified sequence opt3 from VP1__Norovirus__AII73774
augaagauggccagcaacgacgcugcacccuccaaugauggcgccgcggggcuggugccugaaauuaacaaugaagucaugccacucgagccgguugcuggagccucucuugcaacccccgugguaggucagcaaaacauuauagacccuuggaucagaaauaacuucgugcaggccccagcuggcgaauuuacagucucacccaggaauaguccuggggagauucuguuggauuuagaacugggaccagagcuaaaccccuaccucgcacaccuggcccggauguauaauggccaugcuggugggauggaggugcagaucguucuugccggaaacgcguucacugcaggcaaaauuaucuuugccgcuauaccuccaggcuucccguacgaaaaucugagccccucccagaucacgaugugcccucacgugauuaucgacguccgccaauuggagccagugcuccugcccaugccugauauucgaaacaacuuuuuccauuauaaucaggggaaugacccaaagcugcgucucaucgccauguuauacacaccccugagagcaaacaacucuggagaugacguauuuaccguuucguguagggugcuuacuaaaccgucaccugauuucgaauuuaccuucuuggugcccccaacagucgagagcaagaccaaacaguuuacucugccuauacuaaagauuagugagaugacaaauucccgguuccccgugccagucgaaaugauguauaccgcucgcaacgagaaucagguugugcaaccccagaacgguagaguaacgcucgacggcgaacugcuugggacuaccccucuguuggccgugaauaucugcaaguuuaaaggagaggucauugcgaagaacggcgaugugaggucuuaccggauggacauggaaaucacaaauacugaugguaccccaaucgacccgacagaggacacccccgggccuauuggaagcccagauuuccagggcauacucuucggcguugccucccagcgcaacaaaaaugagcaaaaccccgcaacgcgagcucacgaagccaauaucaacacugggggagaccaguaugcuccuaagcuggcccaggugaaauuuuucucagagagucaagauuuugaaguccaucagccaacaguguucacccccguagguguugcaggcgacacuagccacccguuuagacaguggguguuaccuagguacgggggacaccugacaaauaacacccaucucgccccagcugucgcgccccuuuucccuggcgagcagauucuguuuuuccggucucaaauccccuccucaggugggcacgaauugggcuacauggauugucuagugccacaggaguggguccagcauuuuuaucaggaggcagccacggcucaaagcgaaguggcccugauacguuucauuaauccugacaccggacgcguucucuuugaggcaaagcugcacaagcagggcuucaucacaguggcccacacuggggauaaccccaucguaaugccaccgaacggauacuuuagauucgaggcuugggucaaucaguucuauagucuugccccuguggguaccggcaacgggaggcggcgaauccaguga

SEQ ID NO: 18537 - RNA, 1623 nt, Artificial Sequence
  derived and/or modified sequence opt3 from VP1__Norovirus__AII73777
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacggaacacacacaauguccaucucgccccugcuguggcgccaaccuuucccggcgaacagcuguuauucuuucguucuacuaugccugguuguuccggguaucccaacauggaccuggauugccuccuuccacaggaguggguucaauacuucuaucaggaggcagccccugcucagagcgacguggcccuguugcgcuuugucaaucccgauacgggcagagugcuauucgaauguaagcugcacaaaucgggauacguaacaguggcacauaccggccaguaugaccucguuauuccaccgaacggguacuuuagguucgauucuugggucaaccaauucuauacucuggccccuaugggaaaugguaccggccggcgacgcgcuguguga

SEQ ID NO: 18538 - RNA, 1611 nt, Artificial Sequence
  derived and/or modified sequence opt3 from VP1__Norovirus__AII73780
augaagauggccagcaacgacgcuacccccuccgaugacggcgcagccgggcuggugccugagaucaauucugaagucauggcgcucgagccaguugcuggagccucaauugcagccccggugguaggucagcaaaacauaaucgaucccuggauuagaaauaacuucgugcaggcuccugcaggcgaauuuacagucaguccaaggaauagccccggggagcuucuguuggacuuagaacugggaccugagcuaaacccauaccucgcccaccuggcucggauguauaauggccaugccggugggauggaggugcagaucguucuugcgggaaacgcauucacugccggcaaaauucuguuugcugccauucccccuuccuucccauacgaaaauuugucuccggcacagcucacgaugugcccccacgugauagucgaugugcgccaacuggagccuguacugcucccaaugcccgacauccgaaacguguuuuaucauuacaaucagaacaauucgccuaaguuacgucugguugcuaugcuuuauaccccauugagagccaacaauucaggcgaugacgucuucacagugagcuguagggugcugacucggcccaguccggauuuucaguucaccuuucuagucccucccacaguugaauccaaaaccaagaacuucacucucccagugcugcgcguaucugagaugacaaacagcagauuuccugugguccuugaccagauguacaccuccaggaaugagaacacgauugugcaaccccagaaugggcggugcacuaccgauggagaacuguuggguacaacuauccuccagucaguuaguauuuguaacuucaaaggcaccaugcaggcgaagcugaaugaggaaccacgcuaucaauuacagcugacaaaccucgacgggagccccaucgauccuaccgacgacaugccagccccgcuuggaacgcccgauuuucaggcagugcuguacggcgucgcuucucaacgauccucaagagacaaugccacuagggcucacgaugcccagauagacacagcaggggauaccuucgccccuaagauuggucaggugcgguucaaaagcaguucuaacgacuuugauuugcaugacccaacuaaguucacacccaucggaguaaauguugaugaccagcacccuuuucgucaauggucccuaccaaacuacggcggccaccuggcucucaauaaccaucuggcgcccgcagugaccccgcuuuucccuggggagcagauucuguuuuuccgcagcuauaucccaucggccggaggucacacggauggcgcuauggacugcuugcucccccaggaaugggucgagcauuuuuaccaggaggccgcaccuucucaauccgacaucgcccuggugagauucauuaaucccgauaccgggagggucuuauuugaagcuaaacugcacaagcagggauuccuaacaauagccgcaucaggcgaccacccaaucgugaugccuacuaacgguuauuuucgguucgaggcguggguuaaucccuuuuacacccucgcuccaguggggacaggcaguggacgacgcagaauccaguga

SEQ ID NO: 18539 - RNA, 1632 nt, Artificial Sequence
  derived and/or modified sequence opt3 from VP1__Norovirus__AII73783
augaugauggccagcaaggacgcucccaccaacauggauggcacauccggggcaggacagcuggugccugaggccaauacugcggaaccacucccgaucaaacccgucgcuggugccgcaacggccguugcuaccgcaggccaagugaacaugauugacccuuggauaaugaauaacuucguacaggccccacagggggaguuuacaaucucucccaauaacacuccuggagauauucuuuucgaccugcaguugggcccacacuuaaaucccuuucuggcucaucuaucaagaauguacaacgguuggguggggaauaugcaagucaggaucaugcucgccggaaacgcguucagugcaggcaagauuaucgugugcuguauaccuccaggcuuuagcucccagucuaucucgauugcccaggcuaccauguucccgcacguuaucgccgaugugcggguccuggaacccauugacgugccucuugaugacguacgcaauguucuguuucauaacaaugauaacccacagacaaugcgauugcucugcaugcuguauacuccccugcguucagggggaaccagcagugguacagacccuuucgugaucgcaggcagaguccucaccuguccaacgcccgauuuuuccuucuuauuucuggugccgccugacauagagcaaaggacuaaacccuucucugugccaaauauuccuaugaaccuuaugagcaacucccgggucucaauguugaucgaugggaugaugguuaguaaugaccagaaccaggugccccaguuucaaaauggacgcguaacccuggacggccagcuacaggguacaacuaccgugagcgcugccugcgucgcgagaaugagggggcggauuuucaacaauaacggaaauuacggcgugaaccucacagaacuggauggcaauccauaucacgccuucgacucucccgcaccucuuggguuuccagauuucggaaacugugaccugcauaugaccuuuguuaagaucaauccgaacgaguuguccucaggugaucccagcggcaaaguggucauccacaguuacgacgcuacguucgccccucaccucgggacugugaagcuggagaaugaugacgaauuagcucgcuuuguaggaaaggagguugugcuggaacucacaugggucucuaaccgagagggcgccacccuuaaucugugggcagugccaaacuaugguuccagcuugacucaagccucgcagcuagcucccccuauuuacccacccggguucggcgaggcgauagucuauuuuacaucuaccuucccgacgguguccaacccuaaaguuccaugcacccugccccaggaauuugugucacauuucguaaaugagcaggcaccuacaagaggagaugccgcucuccugcacuacgucgaccccgauacucauaggaaccuuggcgaauuuaagauguacccagagggguauaugaccugugugccuaaugccggagguggcccccaaacacugccaaucaacgggguuuucguguuuauuaguugggucagccgguacuaucaguugaaaccggugggaacugcaggcgccgcucgucgccucggucugagaagguccuga

SEQ ID NO: 18540 - RNA, 1608 nt, Artificial Sequence
  derived and/or modified sequence opt3 from VP1__Norovirus__AII73786
augaagauggccagcuccgacgcugcacccucuaacgauggcgccgcggggcuggugccugaggcuaauaacgaaaccauggcccucgagccagucgcaggagccucaaucgcugcaccgcuuacaggucagaauaacauuauagaccccuggaucagacugaauuucguucaagccccuaacggcgaauuuacugugaguccaaggaauagccccggggagguauuguuaaaccuggaacuaggaccugagcucaauccauaccuggcucaccuuucccggauguauaacggcuacgccggugggguggagguccaggugcuguuggcgggaaaugcauucacggccggcaaacucguuuuugcugccgugcccccucauuucccacuggaaaacauuucuccgggccagaucaccauguuuccccacgucauuaucgaugugcgcacacuggagccuguacucuuaccacugcccgacguucgaaauaacuucuuucauuauaaucagcaaaacgaaccucguaugagacuuguggcaauguuguacacuccacugaggucgaacgggucaggagaugacgucuucaccgugagcugccgggugcuaacacgccccaguccggauuuugacuucaauuaucucgucccucccaccguugaguccaagacuaaaccauuuacacugccuauacuuaccaucggugagcugacgaacucuagauuccccgugccaauugaugaauuguacacuagccccaaugagucccucguagugcagccucagaacgggaggugugcucuggacggcgaauuacagggaaccacacaacugcucccaacugccaucugcucauuucggggccgcauuaaucagaaggucaguggugagaaccacguguggaauaugcagguuaccaacaucaaugggacaccguucgaucccaccgaagacgugccugcgccacuuggaacgcccgauuucagcggcaaacuguuuggcgucuugucucagcgagaccaugacaacgccuguagaucccacgaugcagugauagcuacuaauucagccaaguucacaccuaagcuaggggcuauucaaaucggaaccugggaggagaacgacguacacauuaaucagccaacuaaauuuacacccguuggucuguucgaagaugagggcuuuaaccaguggacccucccgaauuauagcggggcccugacgcuuaacaugggacuggcaccuccaguggcccccaccuucccuggcgaacaaaucuuguuuuucaggagucauaucccccucaaggguggggucgcugacccagugauugauugccuguuaccucaggaguggauacagcaccuguaccaggaaucugcgcccucccaaagcgacgucgcacuaauccgguuuacaaacccagauacuggccguguucucuucgaggccaaacugcaucgcucgggauacauuaccguggcuaauacaggcucuagaccgaucgugguaccugccaacggguauuuuagguucgacuccugggucaaucaguuuuacucacuugcacccaugggaacugguaacggccggcgacgcgugcaguga

SEQ ID NO: 18541 - RNA, 1623 nt, Artificial Sequence
  derived and/or modified sequence opt3 from VP1__Norovirus__AIS40019
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugccugcaccagguggcgaauuuaccguuagucccaggaaugccccuggggagauccuuuggagcgcuccacugggacccgauuugaacccuuacuuaucccaccuggcccggauguauaauggcuacgcggguggguucgaagugcaggucauucuagcaggaaacgccuuuacagcuggcaaagugaucuucgccgcaguaccaccgaauuuucccacugagggccucucuccuucgcagguuacgauguucccacauauuguggucgacgugcgccagcuggagcccgugcuuaucccucugccagauguccgaaacaauuuuuaucacuacaaccaaucaaaugaccccaccauaaaguugaucgcuaugcucuauacaccgcugcgugccaacaacgcgggggaugacguuuucacugugagcugcagaguacugaccaggccuagucccgauuuugacuucauuuuucucgugccaccuacagucgaaucccggaccaaacccuucucugugccaguuuuaacuguggaggaaaugacaaauagccgcuuucccaucccucuggagaaacuuuucaccggaccauccucagccuucgucgugcagccgcagaacgguagauguacgacugauggcguauugcugggggcaacccagcuaagucccguuaauauuugcacauuuaggggagacgugacucauaucaccggcagccggaacuacacaaugaaucucgcuucucaaaacugguccaauuaugauccuaccgaggaaauaccagcuccccuggguacgccugacuucgucgggaagauucagggagugcuuacucagacaacccgcacugacggcucaacacgaggccacaaggccaccgucuacacggggagcgccgauuuugcaccaaagcugggaagagugcaguucgagaccgacacagauagggacuuugaagccaaccaaaauacuaaauucacccccguuggugugauccaggauggcaguacaacucaucggaacgagccgcagcaauggguauugccuucuuacuccgggcguaauaccccaaacguccaccucgcucccgcgguggcaccuacauuucccggagaacagcuguuauucuuucgcagcaccaugccaggcuguucggguuauccuaauauggaccuggauugccuccuuccccaggaguggguucaguacuucuaucaagaggccgcuccagcccagucugacguggcacuguugagauuugucaacccggauacugggagggugcuauucgaauguaagcugcacaaauccggcuacguaacgguggcccauacaggacagcacgaccucguuauuccucccaauggcuauuuucgguucgauucaugggucaaccaguucuacacccuggcuccaauggggaacggaacuggucgacgcagagcccuuuga

SEQ ID NO: 18542 - RNA, 1623 nt, Artificial Sequence; identical to SEQ ID NO: 18313
  derived and/or modified sequence opt3 from VP1__Norovirus__AIV43147

SEQ ID NO: 18543 - RNA, 1623 nt, Artificial Sequence; identical to SEQ ID NO: 18317
  derived and/or modified sequence opt3 from VP1__Norovirus__AIV43148

SEQ ID NO: 18544 - RNA, 1623 nt, Artificial Sequence; identical to SEQ ID NO: 18317
  derived and/or modified sequence opt3 from VP1__Norovirus__AIV43149

SEQ ID NO: 18545 - RNA, 1623 nt, Artificial Sequence
  derived and/or modified sequence opt3 from VP1__Norovirus__AIV43150
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaucccacuggagaaacuuuucaccggacccucaagugccuucgucgugcagccucagaacgguagauguacgacugauggcguauugcuggggaccacacaacuaagcccaguuaauauuugcacuuuuaggggagacgugacccauaucacaggcucucggaacuacaccaugaaucucgcaucccagaacuggucaaauuaugauccgacggaggaaauacccgcuccucuggguacuccagacuucgucgggaagauucagggagugcuuacacagaccacucgcacagacggcagcacccgaggccacaaggccacggucuacaccgggagugcugauuuugcccccaagcugggaagagugcaauucgagacagacacugaucaugacuuugaagcaaaccagaauaccaaauucacaccuguuggugugauccaggauggcgggacuacccacaggaacgagccacaacaguggguauugcccucuuacuccggacggaauacaccgaacguccaccucgccccugcuguggcgccaaccuuucccggcgaacagcuguuauucuuucguagcacuaugccugguuguucgggguaucccaauauggaccuggauugccuccuuccacaggaguggguucaauacuucuaucaggaggcagccccugcucagucugacguggcccuguugcgcuuugucaaccccgauacgggcagagugcuauucgaauguaagcugcauaaauccggauacguaacaguggcacacaccggccagcaugaccucguuauuccaccgaauggguauuuuagguucgauucaugggucaaccaauucuacacucuggccccuaugggaaacgguaccggccggcgacgcgcucuuuga

SEQ ID NO: 18546 - RNA, 1623 nt, Artificial Sequence
  derived and/or modified sequence opt3 from VP1__Norovirus__AIV43151
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaugacccaaccaucaaguugauugcuaugcucuauacaccccugcgugccaacaacgcgggggaugacgucuucacuguuagcugcagagugcugaccaggccgaguccugauuuugacuucaucuuucucguacccccaacaguggaaucccggaccaaaccuuucucuguccccguguuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacugguccaauuaugaucccacggaggaaauuccugcuccacuggguacucccgacuucguggggaagauccagggaguccuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauucaggauggcgggacuacccacaggaacgagccccaacaguggguguugccgaguuacucuggacggaauacaccuaacguacaccucgccccagcugucgcgcccaccuuuccuggcgaacagcuguuauucuuucguuccacuaugcccgguuguagcggguauccaaauauggaccuggauugccuccuuccucaggagugggugcaauacuucuaucaggaggcagcccccgcucagucggacguugcccuguugcgcuuugugaacccagauacgggcagaguccuauucgaauguaagcugcauaaaucuggauacgugacaguagcacacaccggccagcaugaccucgugaucccgccuaauggguauuuuagguucgauuccuggguuaaccaauucuacacucuggcccccaugggaaacgguaccggccggcgacgcgcucuuuga

SEQ ID NO: 18547 - RNA, 1623 nt, Artificial Sequence; identical to SEQ ID NO: 18313
  derived and/or modified sequence opt3 from VP1__Norovirus__AIV43152

SEQ ID NO: 18548 - RNA, 1623 nt, Artificial Sequence; identical to SEQ ID NO: 18313
  derived and/or modified sequence opt3 from VP1__Norovirus__AIV43153

SEQ ID NO: 18549 - RNA, 1623 nt, Artificial Sequence; identical to SEQ ID NO: 18313
  derived and/or modified sequence opt3 from VP1__Norovirus__AIV43154

SEQ ID NO: 18550 - RNA, 1623 nt, Artificial Sequence; identical to SEQ ID NO: 18265
  derived and/or modified sequence opt3 from VP1__Norovirus__AIV43155

SEQ ID NO: 18551 - RNA, 1623 nt, Artificial Sequence
  derived and/or modified sequence opt3 from VP1__Norovirus__AIV43156
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacuggccaggccgaguccugauuuugacuucauuuuucucgugcccccaaccgucgaaucccggacaaaaccuuucucugugcccguuuuaaccguggaggaaaugacuaauagccgcuuuccaaucccccuggagaaacuuuucacaggaccuuccucagcauucgucgugcagccacagaacgguagauguaccacggauggcguauugcuggggacuacccaacuaaguccgguuaauauuugcacauuuaggggagacgugacucauaucaccggcagccggaacuacacaaugaaucucgcuucucagaacugguccaauuaugaucccaccgaggaaauaccugccccacuggguacgcccgacuucgucgggaagauucagggagugcuuacucagacaaccaagacugacggcucaacacgcggccacaaggcuaccgucuacacggggagcgccgauuuugcaccuaaacugggacgagugcaauucgagaccgacacagaucaugacuuugaagccaaccagaauacuaaguucaccccaguuggugugauccaggauggcaguacaacucacagaaacgagccccaacaguggguauugccgucuuacuccgggaggaauaccccuaacguccaccucgcuccagcgguggcacccacauuuccuggagaacagcuguuauucuuucggagcaccaugcccggcuguucggguuauccaaauauggaccuggauugccuccuuccucaggaguggguucaauacuucuaucaggaggccgcucccgcccagucugacguggcacuguugcguuuugucaacccagauacugggcgcgugcuauucgaauguaaacugcauaaguccggcuacguaacgguggcccacacaggacagcaugaccucguuauuccgccuaauggcuauuuuagauucgauucaugggucaaccaauucuacacccuggcucccauggggaacggaacugguaggcggcgagcccuuuga

SEQ ID NO: 18552 - RNA, 1623 nt, Artificial Sequence
  derived and/or modified sequence opt3 from VP1__Norovirus__AIV43159
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacuggccaggccgaguccugauuuugacuucauuuuucucgugcccccaaccgucgaaucccggacaaaaccuuucucugugcccguuuuaaccguggaggaaaugacuaauagccgcuuuccaaucccccuggagaaacuuuucacaggaccuuccucagcauucgucgugcagccacagaacgguagauguaccacggauggcguauugcuggggacuacccaacuaaguccgguuaauauuugcacauuuaggggagacgugacucauaucaccggcagccggaacuacacaaugaaucucgcuucucagaacugguccaauuaugaucccaccgaggaaauaccugccccacuggguacgcccgacuucgucgggaagauucagggagugcuuacucagacaacccgcacugacggcucaacacgaggccacaaggcuaccgucuacacggggagcgccgauuuugcaccuaagcugggaagagugcaauucgagaccgacacagaucaugacuuugaagccaaccagaauacuaaauucaccccaguuggugugauccaggauggcaguacaacucacaggaacgagccccaacaguggguauugccgucuuacuccgggcggaauaccccuaacguccaccucgcuccagcgguggcacccacauuuccuggagaacagcuguuauucuuucguagcaccaugcccggcuguucggguuauccaaauauggaccuggauugccuccuuccucaggaguggguucaauacuucuaucaggaggccgcucccgcccagucugacguggcacuguugcgcuuugucaacccagauacugggagagugcuauucgaauguaagcugcauaaauccggcuacguaacgguggcccacacaggacagcaugaccucguuauuccgccuaauggcuauuuuagguucgauucaugggucaaccaauucuacacccuggcucccauggggaacggaacuggucggcgacgcgcccuuuga

SEQ ID NO: 18553 - RNA, 1623 nt, Artificial Sequence
  derived and/or modified sequence opt3 from VP1__Norovirus__AIV43160
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugauccauauaaccggcagccggaacuacacaaugaaucucgcaucucagaacugguccaauuaugaucccaccgaggaaauuccugcuccacuggguacgcccgacuucgucgggaagauccagggagugcuuacucagacaacccgcacugacggcucaacacgaggccacaaggccaccgucuacacggggagcgcugauuuugccccuaagcugggaagagugcaauucgagaccgacacagaucaugacuuugaagcaaaccagaauacuaaauucaccccaguuggugugauucaggauggcaguacaacucacaggaacgagccccaacaguggguauugccgucuuacuccgggcggaauaccccuaacguccaccucgccccagcuguggcgcccacauuuccuggagaacagcuguuauucuuucguagcaccaugcccggcuguucggguuauccaaauauggaccuggauugccuccuuccucaggaguggguucaauacuucuaucaggaggcagcccccgcucagucugacguggcccuguugcgcuuugucaacccagauacugggagagugcuauucgaauguaagcugcauaaauccggcuacguaacgguggcacacacaggacagcaugaccucguuaucccgccuaauggcuauuuuagguucgauucaugggucaaccaauucuacacccuggcccccauggggaacggaacuggucggcgacgcgcucuuuga

SEQ ID NO: 18554 - RNA, 1623 nt, Artificial Sequence; identical to SEQ ID NO: 18553
  derived and/or modified sequence opt3 from VP1__Norovirus__AIV43161

SEQ ID NO: 18555 - RNA, 1623 nt, Artificial Sequence; identical to SEQ ID NO: 18313
  derived and/or modified sequence opt3 from VP1__Norovirus__AIV43162

SEQ ID NO: 18556 - RNA, 1623 nt, Artificial Sequence; identical to SEQ ID NO: 18313
  derived and/or modified sequence opt3 from VP1__Norovirus__AIV43163

SEQ ID NO: 18557 - RNA, 1623 nt, Artificial Sequence; identical to SEQ ID NO: 18553
  derived and/or modified sequence opt3 from VP1__Norovirus__AIV43164

SEQ ID NO: 18558 - RNA, 1623 nt, Artificial Sequence
  derived and/or modified sequence opt3 from VP1__Norovirus__AIV43165
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaguaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgucuuacuccggacggaacacaccuaauguccaccucgccccagcuguggcgcccaccuuuccuggcgaacagcuguuauucuuucguagcacuaugcccgguuguucgggguauccaaacauggaccuggauugccuccuuccucaggaguggguucaauacuucuaucaggaggcagcccccgcucagucugacguggcccuguugcgcuuugucaauccagauacgggcagagugcuauucgaauguaagcugcauaaauccggauacguaacaguggcacacaccggccagcaugaccucguuauuccgccuaacggguauuuuagguucgauucaugggucaaucaauucuacacucuggcccccaugggaaacgguaccggccggcgacgcgcucuuuga

SEQ ID NO: 18559 - RNA, 1623 nt, Artificial Sequence
  derived and/or modified sequence opt3 from VP1__Norovirus__AIV43166
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccaucuuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacugguccaauuaugaucccacggaggaaauuccugcuccacuggguacucccgacuucguggggaagauccagggaguccuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauucaggauggcaguacuacccacaggaacgagccccaacaguggguguugccgucuuacuccgggcggaauacaccuaacguacaccucgccccagcugucgcgcccaccuuuccuggagaacagcuguuauucuuucguagcacuaugcccggcuguucggguuauccaaauauggaccuggauugccuccuuccucaggagugggugcaauacuucuaucaggaggcagcccccgcucagucugacguugcccuguugcgcuuugugaacccagauacggggagaguccuauucgaauguaagcugcauaaauccggcuacgugacaguagcacacaccggacagcaugaccucgugaucccgccuaauggcuauuuuagguucgauucauggguuaaccaauucuacacucuggcccccauggggaacggaaccggucggcgacgcgcucuuuga

SEQ ID NO: 18560 - RNA, 1623 nt, Artificial Sequence
  derived and/or modified sequence opt3 from VP1__Norovirus__AIV43167
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaaaccaaccagaauacaaaauucacuccaguuggugugauccaggauggcaguaccacacacaggaacgagccccaacaguggguauugccgucuuacuccgggcggaauaccccuaacguccaccucgcaccagccguggcucccacuuuuccuggagaacagcuguuauucuuucguagcacgaugcccggcuguucggguuauccaaauauggaccuggauugccuccuuccucaggaguggguucaauacuucuaucaggaggcggcacccgcccagucugacguggcucuguugcgcuuugucaacccagauacagggagagugcuauucgaauguaagcugcauaaauccggcuacguaaccguggcccacacuggacagcaugaccucguuauuccgccuaauggcuauuuuagguucgauucaugggucaaccaauucuacacccuggcacccauggggaacggaacaggucggcgacgcgcccuuuga

SEQ ID NO: 18561 - RNA, 1623 nt, Artificial Sequence
  derived and/or modified sequence opt3 from VP1__Norovirus__AIV43171
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuugccccuaagcugggacgagugcaauucgagacagacacuaaucacgauuuugaagcaaaccagaauaccaaauucacaccaguuggugugauccaggacggcgggacuacccacagaaacgagccccaacaguggguauugccgagcuacaguggaaggaauacaccuaacguccaucucgccccagcuguggcgcccaccuuuccuggcgaacagcuguuauucuuucggucuacuaugcccgguuguuccggguauccaaauauggaucuggacugccuccuuccucaggaguggguucaauacuucuaucaggaggcagcccccgcucagagcgauguggcccuguugcguuuugucaacccagacacgggccgcgugcuauucgaauguaagcugcacaaaucgggauacguaacaguggcacauaccggccagcacgaucucguuauuccgccuaacggguauuuuagauucgacucuugggucaaucaauucuacacucuggcccccaugggaaacgguaccggcaggcggcgagcucuuuga

SEQ ID NO: 18562 - RNA, 1623 nt, Artificial Sequence
  derived and/or modified sequence opt3 from VP1__Norovirus__AIV43172
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggaaugcuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauccaggauggcaguacuacccacaggaacgagccccaacaguggguguugccgucuuacuccgggcggaauacaccuaacguacaccucgccccagcugucgcgcccaccuuuccuggagaacagcuguuauucuuucguagcacuaugcccggcuguucggguuauccaaauauggaccuggauugccuccuuccucaggagugggugcaauacuucuaucaggaggcagcccccgcucagucugacguugcccuguugcgcuuugugaacccagauacggggagaguccuauucgaauguaagcugcauaaauccggcuacgugacaguagcacacaccggacagcaugaccucgugauuccgccuaauggcuauuuuagguucgauucauggguuaaccaauucuacacucuggcccccauggggaacggaaccggucggcgacgcgcucuuuga

SEQ ID NO: 18563 - RNA, 1623 nt, Artificial Sequence
  derived and/or modified sequence opt3 from VP1__Norovirus__AIV43173
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuugccccuaagcugggacgaauccaauucgagacagacacuaaucacgauuuugaagcaaaccagaauaccaaauucacaccaguggguguuauucaggacggcgggacuacccacagaaacgagccccaacaguggguguugccgagcuacaguggaaggaauacaccuaacguacaucucgccccagcugucgcgcccaccuuuccuggcgaacagcuguuauucuuucggucuacuaugcccgguuguuccggguauccaaauauggaucuggacugccuccuuccucaggagugggugcaauacuucuaucaggaggcagcccccgcucagagcgauguugcccuguugcguuuugugaacccagacacgggccgcguccuauucgaauguaagcugcacaaaucgggauacgugacaguagcacauaccggccagcacgaucucgugaucccgccuaacggguauuuuagauucgacucuuggguuaaucaauucuacacucuggcccccaugggaaacgguaccggcaggcggcgagcucuuuga

SEQ ID NO: 18564 - RNA, 1623 nt, Artificial Sequence
  derived and/or modified sequence opt3 from VP1__Norovirus__AIV43174
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuuagcccuaagcugggaagagugcaauucgagacagacacugaucaugacuuugaagccaaucagaacaccaaauucacaccaguuggugugauccaggauggcgggacuacccacaggaaugagccccaacaguggguauugccgaguuacucuggacggaacacaccuaauguccaccucgcaccagccguggcucccaccuuuccuggcgaacagcuguuauucuuucguuccacuaugcccgguuguagcggguauccaaacauggaccuggauugccuccuuccucaggaguggguucaauacuucuaucaggaggcggcacccgcccagucggacguggcucuguugcgcuuugucaauccagauacgggcagagugcuauucgaauguaagcugcauaaaucuggauacguaacaguggcccacaccggccagcaugaccucguuauuccgccuaacggguauuuuagguucgauuccugggucaaccaauucuacacucuggcacccaugggaaaugguaccggccggcgacgcgcccuuuga

SEQ ID NO: 18565 - RNA, 1623 nt, Artificial Sequence; identical to SEQ ID NO: 18564
  derived and/or modified sequence opt3 from VP1__Norovirus__AIV43175

SEQ ID NO: 18566 - RNA, 1623 nt, Artificial Sequence; identical to SEQ ID NO: 18313
  derived and/or modified sequence opt3 from VP1__Norovirus__AIV43176

SEQ ID NO: 18567 - RNA, 1623 nt, Artificial Sequence; identical to SEQ ID NO: 18508
  derived and/or modified sequence opt3 from VP1__Norovirus__AIV43177

SEQ ID NO: 18568 - RNA, 1623 nt, Artificial Sequence; identical to SEQ ID NO: 18562
  derived and/or modified sequence opt3 from VP1__Norovirus__AIV43178

SEQ ID NO: 18569 - RNA, 1623 nt, Artificial Sequence
  derived and/or modified sequence opt3 from VP1__Norovirus__AIV43179
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggacauaccugcuccacuggguacucccgacuucgucgggaagauucagggagugcuuacacagaccacucgcacagauggcucaacccgaggccacaaggccacggucuacaccgggagcgcugacuuugccccuaagcugggaagagugcaauucgaaacagauacugaccaugauuuugaggcaaaccagaauaccaaauucacaccaguuggugugauccaggacggcgggacuacccacaggaacgaaccccaacaguggguauugccgaguuacucuggacggaauacaccuaacguccaccucgccccagcuguggcgcccaccuuuccuggcgagcagcuguuauucuuucguuccacuaugcccgguuguagcggguauccaaauauggaucuggacugccuccuuccucaggaauggguucaauacuucuaucaggaggcagcccccgcucagucggauguggcccuguugcgcuuugucaacccagacacgggcagagugcuauucgaguguaagcugcauaaaucuggauacguaacaguggcacacaccggccagcaugaucucguuauuccgccuaauggguauuuuagguucgacuccugggucaaccaauucuacacucuggcccccaugggaaacgguaccggccggcgacgcgcucuuuga

SEQ ID NO: 18570 - RNA, 1623 nt, Artificial Sequence
  derived and/or modified sequence opt3 from VP1__Norovirus__AIY27747
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaagugaucuucgccgcaguaccuccaaacuuuccgacugagggccucucccccucucagguuacgauguucccucauauuguggucgacgugcgccaacuggagccagugcuuaucccccugccugauguccgaaauaacuuuuaucacuacaaucagucgaacgacccaaccauaaaguugaucgcuaugcucuauacaccccugcgugccaacaaugcgggggaugacguuuucacugugucaugcagaguacugaccaggccgagcccugauuuugacuucauuuuucucgugcccccaacagucgaaagucggaccaaaccuuucuccgugcccguuuuaacuguggaggaaaugacaaacucucgcuuuccaaucccccuggagaaacuuuucaccggaccuagcuccgccuucgucgugcagccacagaaugguagauguacgacugauggcguauugcuggggaccacacaacuaucaccgguuaacauuugcacuuuuaggggagacgugacccauaucacaggcagucggaauuacaccaugaaccucgcaagccagaauuggaacaauuaugaucccacggaggaaauaccugcuccacuggguacucccgacuucgucgggaagauucagggagugcuuacacagaccacucgcacagacggcucuacccgaggccacaaggccacggucuacaccggguccgcugauuuugccccuaagcugggaagagugcaauucgagacagacacugaucaugacuuugaagcaaaccagaauaccaaauucacaccaguuggugugauccaggauggcucaacuacccacaggaacgagccccaacaguggguauugccgagcuacagugggcggaauacaccuaacguccaccucgccccagcuguggcgcccaccuuuccuggagaacagcuguuauucuuucguucuacuaugcccggcuguuccgguuauccaaauauggaccuggauugccuccuuccucaggaguggguucaauacuucuaucaggaggcagcccccgcucagagcgacguggcccuguugcgcuuugucaacccagauacggggagagugcuauucgaauguaagcugcauaaaucgggcuacguaacaguggcacacaccggacagcaugaccucguuauuccgccuaacggcuauuuuagguucgauucuugggucaaucaauucuacacucuggcccccauggggaacggaaccggucggcgacgcgcucuuuga

SEQ ID NO: 18571 - RNA, 1623 nt, Artificial Sequence; identical to SEQ ID NO: 18564
  derived and/or modified sequence opt3 from VP1__Norovirus__AJA71387

SEQ ID NO: 18572 - RNA, 1623 nt, Artificial Sequence
  derived and/or modified sequence opt3 from VP1__Norovirus__AJA71388
augaagauggccagcuccgacgcuaaccccucugauggcucagcagccaaucuggugccugaggucaacaaugaaguucucgcgcuugagccagugguaggggcugccaucgcagccccgguggcuggacagcaaaacgucauugaccccuggauaagaaauaacuucgugcaggcaccugguggcgaauuuaccguuaguccaaggaaugcccccggggagauccuguggagcgcuccuuugggaccagauuuaaaccccuaccugucccaccuagcccggauguauaauggcuacgcggguggguucgaagugcaggucauucucgcaggaaacgccuuuacagcuggcaaagugaucuucgccgcaguaccuccaaauuuuccgacugagggccugucucccucgcagguuacgauguucccucauauuguggucgacgugcgccaacuugagccagugcugauccccuugccugauguccgaaacaauuuuuaucacuacaaccagucaaaugacccaaccauaaagcucaucgcuaugcuguauacaccccugcgugccaacaacgcgggggaugacguuuucacugugagcugcagaguacucaccaggccgaguccugauuuugacuucaucuuuuuagugcccccaacagucgaaucccggaccaaaccuuucucugugcccauucugacuguugaggaaaugacaaauagccgcuuuccaauuccccuugagaaguuguucaccggaccuuccucagccuucgugguccagccacagaacgguagauguacgacugauggcgugcugcuagggaccacacaacucaguccgguaaauaucugcacuuuuaggggagacguuacccauauaacaggcagccacaacuacaccaugaaucuggcaucucagaacugguccaauuaugaucccacggaggaaauuccugcuccacuugguacucccgacuucguggggaaaauccagggaguccugacacagaccacucggacagacggcucaacccgcggccauaaggccacgguguacaccgggagcgcugauuuugccccuaaguugggacgaguccaauucgagacagacacugauagagacuuugaagcaaaccagaauaccaaauucacaccaguggguguuauucaggauggcgggacuacccacaggaacgagccccaacagugggugcucccgaguuacucuggacggaauacaccuaacguacaccuggccccagcugucgcgcccaccuuuccuggcgaacaguuacuguucuuucguuccacuaugcccgguuguagcggguauccaaauauggaccucgauugccuucugccucaggagugggugcaauacuucuaucaggaggcagcccccgcucagucggacguugccuugcuacgcuuugugaacccagauacgggcagaguccuguucgaauguaagcuccauaaaucuggauacgugacaguagcacacaccggccagcaugaccuggugaucccgccuaauggguauuuuagguucgauuccuggguuaaccaauucuacacucuugcccccaugggaaacgguaccggccggcgacgcgcucuguga

SEQ ID NO: 18573 - RNA, 1623 nt, Artificial Sequence; identical to SEQ ID NO: 18562
  derived and/or modified sequence opt3 from VP1__Norovirus__AJA71389

SEQ ID NO: 18574 - RNA, 1623 nt, Artificial Sequence
  derived and/or modified sequence opt3 from VP1__Norovirus__AJA71390
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcuugcugcuagggaccacacaacucaguccgguaaauauuugcacuuuuaggggagacguuacccauaucacaggcagccggaacuacaccaugaaucuggcaucucagaacugguccaauuaugaucccacggaggaaauaccugcuccacuugguacucccgacuucguggggaagauucagggaguccugacacagaccacucgcacagacggcucaacccgaggccacaaggccacgguguacaccgggagcgcugauuuugccccuaaguugggaagaguccaauucgagacagacacugaucaugacuuugaagcaaaccagaauaccaaauucacaccaguggguguuauccaggauggcgggacuacccacaggaacgagccccaacagugggugcucccgaguuacucuggacggaauacaccuaacguacaccuggccccagcugucgcgcccaccuuuccuggcgaacaguuacuguucuuucguuccacuaugcccgguuguagcggguauccaaauauggaccucgauugccuucugccucaggagugggugcaauacuucuaucaggaggcagcccccgcucagucggacguugccuugcuacgcuuugugaacccagauacgggcagaguccuguucgaauguaagcuccauaaaucuggauacgugacaguagcacacaccggccagcaugaccuggugauuccgccuaauggguauuuuagguucgauuccuggguuaaccaauucuacacucuugcccccaugggaaacgguaccggccggcgacgcgcucuguga

SEQ ID NO: 18575 - RNA, 1623 nt, Artificial Sequence; identical to SEQ ID NO: 18313
  derived and/or modified sequence opt3 from VP1__Norovirus__AJA71392

SEQ ID NO: 18576 - RNA, 1623 nt, Artificial Sequence; identical to SEQ ID NO: 18317
  derived and/or modified sequence opt3 from VP1__Norovirus__AJA71393

SEQ ID NO: 18577 - RNA, 1623 nt, Artificial Sequence
  derived and/or modified sequence opt3 from VP1__Norovirus__AJA71394
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaucgggagcgcugauuuugccccuaagcugggacgagugcaauucgagaccgacacaaaccacgauuuugaagcaaaucagaacacuaaauucaccccaguuggugugauucaggacggcgggacaacucacagaaaugagccccaacaguggguauugccgaguuacucuggaaggaacaccccuaauguccaucucgccccagcuguggcgcccacauuuccuggcgaacagcuguuauucuuucgguccaccaugcccgguuguagcggguauccaaacauggaucuggacugccuccuuccucaggaguggguucaauacuucuaucaggaggcagcccccgcucagucggauguggcccuguugcguuuugucaauccagacacuggccgcgugcuauucgaauguaagcugcacaaaucuggauacguaacgguggcacauacaggccagcacgaucucguuaucccgccuaacggguauuuuagauucgacuccagggucaaccaauucuacacccuggcccccaugggaaaugguacuggccggcgacgcgcucuuuga

SEQ ID NO: 18578 - RNA, 1623 nt, Artificial Sequence; identical to SEQ ID NO: 18508
  derived and/or modified sequence opt3 from VP1__Norovirus__AJA71395

SEQ ID NO: 18579 - RNA, 1623 nt, Artificial Sequence
  derived and/or modified sequence opt3 from VP1__Norovirus__AJA71396
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggaaugcuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauccaggauggcaguacuacccacaggaacgagccccaacaguggguguugccgucuuacuccgggcggaauacaccuaacguacaccucgccccagcugucgcgcccaccuuuccuggagaacagcuguuauucuuucguagcacuaugcccggcuguucggguuauccaaauauggaccuggauugccuccuuccucaggagugggugcaauacuucuaucaggaggcagcccccgcucagucugacguugcccuguugcgcuuugugaacccagauacggggagaguccuauucgaauguaagcugcauaaauccggcuacgugacaguagcauauaccggacagcacgaccucgugauuccgccuaauggcuacuuuagguucgauucauggguuaaccaauucuauacucuggcccccauggggaacggaaccggucggcgacgcgcucuuuga

SEQ ID NO: 18580 - RNA, 1623 nt, Artificial Sequence
  derived and/or modified sequence opt3 from VP1__Norovirus__AJA71399
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauugcuguggacguccgccaacuggagccagugcuuaucccccugccugaugugcgaaacaauuuuuaucacuacaaccagucaaaugacccaaccauaaaguugaucgccaugcucuauacaccccugcgugcgaacaacgccggggaugacgucuucacuguuagcugcagagugcugaccaggccgaguccugauuuugacuucauuuuucucguacccccaacaguggaaucccggaccaaaccuuucucuguccccguguuaacuguugaggaaaugacaaauagccgcuuuccaaucccccuggagaaacuuuucaccggaccuuccucagcauucgugguccagccacagaacgguagauguacgacugauggcguguugcuggggaccacacaacuaaguccgguaaauauuugcacuuuuaggggagacguuacccauaucacaggcagccggaacuacaccaugaaucucgcuucucagaacugguccaauuaugaucccacggaggaaauaccugccccacuggguacucccgacuucguggggaagauucagggaguccuuacacagaccacucgcacagacggcucaacccgaggccacaaggcuacgguguacaccgggagcgccgauuuugcaccuaagcugggaagaguccaauucgagacagacacugaucaugacuuugaagccaaccagaauaccaaauucacaccaguggguguuauccaggauggcgggacuacccacaggaacgagccccaacaguggguguugccgaguuacucuggacggaauacaccuaacguacaccucgcuccagcggucgcacccaccuuuccuggcgaacagcuguuauucuuucguuccacuaugcccgguuguagcggguauccaaauauggaccuggauugccuccuuccucaggagugggugcaauacuucuaucaggaggccgcucccgcccagucggacguugcacuguugcgcuuugugaacccagauacgggcagaguccuauucgaauguaagcugcauaaaucuggauacgugacaguagcccacaccggccagcaugaccucgugauuccgccuaauggguauuuuagguucgauuccuggguuaaccaauucuacacucuggcucccaugggaaacgguaccggccggcgacgcgcccuuuga

SEQ ID NO: 18581 - RNA, 1623 nt, Artificial Sequence
  derived and/or modified sequence opt3 from VP1__Norovirus__AJA71400
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaaaccaaccagaauacaaaauucacuccaguuggugugauccaggauggcgggaccacacaucggaacgagccccaacaguggguauugccgaguuacucuggacguaauaccccuaacguccaccucgcaccagccguggcucccacuuuuccuggcgaacagcuguuauucuuucgcuccacgaugcccgguuguagcggguauccaaauauggaccuggauugccuccuuccucaggaguggguucaauacuucuaucaggaggcggcacccgcccagucggacguggcucuguugagauuugucaacccagauacaggcagggugcuauucgaauguaagcugcacaaaucuggauacguaaccguggcccauacuggccagcacgaccucguuauuccgccuaauggguauuuucgguucgauuccugggucaaccaauucuacacccuggcacccaugggaaacgguacaggccgacgcagagcccuuuga

SEQ ID NO: 18582 - RNA, 1623 nt, Artificial Sequence
  derived and/or modified sequence opt3 from VP1__Norovirus__AJA71401
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacaucacccauauaacaggcagccggaacuacaccaugaaucucgcaucucagaacugguccaauuaugaucccacggaggaaauuccugcuccacuggguacucccgacuucguggggaagauccagggaguccuuacacagaccacucgcacagacggcucaacccgaggccacaaggccacgguguacaccgggagcgcugauuuugccccuaagcugggaagaguccaauucgguacagacacugaucaugacuuugaggcaaaccagaauaccaaauucacaccagugggcguuauucaggaugggaguacuacccacaggaacgaaccccaacaguggguguugccgucuuacuccggacggaauacaccuaacguacaccucgccccagcugucgcgcccaccuuuccuggcgagcagcuguuauucuuucguagcacuaugcccgguuguucgggguauccaaauauggaccuggauugccuccuuccucaggaaugggugcaauacuucuaucaggaggcagcccccgcucagucugacguugcccuguugcgcuuugugaacccagauacgggcagaguccuauucgaguguaagcugcauaaauccggauacgugacaguagcacacaccggccagcaugaccucgugaucccgccuaauggguauuuuagguucgauucauggguuaaccaauucuacacucuggcccccaugggaaacgguaccggccggcgacgcgcucuuuga

SEQ ID NO: 18583 - RNA, 1623 nt, Artificial Sequence; identical to SEQ ID NO: 18317
  derived and/or modified sequence opt3 from VP1__Norovirus__AJA71402

SEQ ID NO: 18584 - RNA, 1623 nt, Artificial Sequence
  derived and/or modified sequence opt3 from VP1__Norovirus__AJA71403
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacaaucgaaucccggaccaaaccuuucucuguccccguguuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacuggaauaacuaugaucccacggaggaaauuccugcuccacuggguacucccgacuucguggggaagauccagggaguccuuacacagaccacucgcacagacggcuccacccgaggccacaaggccacgguguacaccgggucagcugauuuuagcccuaagcugggaagaguccaauucgagacagacacugaucaugacuuugaagccaaucagaacaccaaauucacaccaguggguguuauucaggauggcgggacuacccacaggaaugagccccaacaguggguguugccgaguuacucuggacggaacacaccuaauguacaccucgcaccagccgucgcucccaccuuuccuggcgaacagcuguuauucuuucguuccacuaugcccgguuguagcggguauccaaacauggaccuggauugccuccuuccucaggagugggugcaauacuucuaucaggaggcggcacccgcccagucggacguugcucuguugcgcuuugugaauccagauacgggcagaguccuauucgaauguaagcugcauaaaucuggauacgugacaguagcccacaccggccagcaugaccucgugaucccgccuaacggguauuuuagguucgauuccuggguuaaccaauucuacacucuggcacccaugggaaaugguaccggccggcgacgcgcccuuuga

SEQ ID NO: 18585 - RNA, 1623 nt, Artificial Sequence; identical to SEQ ID NO: 18581
  derived and/or modified sequence opt3 from VP1__Norovirus__AJA71404

SEQ ID NO: 18586 - RNA, 1623 nt, Artificial Sequence
  derived and/or modified sequence opt3 from VP1__Norovirus__AJA71405
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagaccaaugacccaacaauaaaguugaucgcuaugcucuauacuccccugcgugccaacaacgcgggggaugacguuuucaccgugucaugcagaguacugacaaggccgagcccugauuuugacuucauuuuucucgugcccccaaccgucgaaagucggacuaaaccuuucuccgugcccguuuuaacaguggaggaaaugaccaauucucgcuuuccaaucccccuggagaaacuuuucacgggaccuagcuccgccuucgucgugcagccacagaacgguagauguacuaccgauggcguauugcuggggacaacucaacuaucaccgguuaauauuugcaccuuuaggggagacgugacacauaucaccggcagucggaacuacacgaugaaucucgcaagccagaacuggaauaacuaugaucccacugaggaaauaccugcuccacuggguauucccgacuucgucgggaagauccagggaaugcuuacacagaccacucgcacagacggcucuacccgaggccacaaggccacgguguacaccggguccgucgauuuugcuccuaagcugggaagagugcaauucgagacagacacugaucaugacuuugaagccaaucagaacaccaaauucacaccaguuggugugauucaggauggcucaacuacccacaggaaugagccccaacaguggguauugccgagcuacagugggcggaacacaccuaauguccaccucgcaccagccguggcucccaccuuuccuggagaacagcuguuauucuuucguucuacuaugcccggcuguuccgguuauccaaacauggaccuggauugccuccuuccucaggaguggguucaauacuucuaucaggaggcggcacccgcccagagcgacguggcucuguugcgcuuugucaauccagauacggggagagugcuauucgaauguaagcugcauaaaucgggcuacguaacaguggcccacaccggacagcaugaccucguuaucccgccuaacggcuauuuuagguucgauucuugggucaaccaauucuacacucuggcacccauggggaauggaaccggucggcgacgcgcccuuuga

SEQ ID NO: 18587 - RNA, 1623 nt, Artificial Sequence
  derived and/or modified sequence opt3 from VP1__Norovirus__AJA71406
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcagcacuacccacaggaaugagccccaacaguggguauugccgaguuacucugggcggaacacaccuaauguccaccucgccccagcuguggcgcccaccuuuccuggagaacagcuguuauucuuucguuccacuaugcccggcuguagcgguuauccaaacauggaccuggauugccuccuuccucaggaguggguucaauacuucuaucaggaggcagcccccgcucagucggacguggcccuguugcgcuuugucaauccagauacggggagagugcuauucgaauguaagcugcauaaaucuggcuacguaacaguggcacacaccggacagcaugaccucguuauuccgccuaacggcuauuuuagguucgauuccugggucaaccaauucuacacucuggcccccauggggaauggaaccggucggcgacgcgcucuuuga

SEQ ID NO: 18588 - RNA, 1623 nt, Artificial Sequence
  derived and/or modified sequence opt3 from VP1__Norovirus__AJA71407
augaagauggccagcuccgacgcuacccccucugauggcucagcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuacaguuaguccaaggaacgcccccggggagauccuuuggagcgcuccucugggaccagauuugaaucccuacuuaucccaccuggcccggauguauaacggcuacgcggguggguucgaagugcaggucauucuagcaggaaaugccuuuacugcuggcaaagugaucuucgccgcaguaccuccaaacuuuccgacggagggccucucucccucgcagguuaccauguucccucauauuguggucgacgugcgccaacuggagccagugcuuaucccccugccugauguccgaaauaacuuuuaucacuacaaucagucaaacgacccaacaauaaaguugaucgcuaugcucuauacuccccugcgugccaauaacgcgggggaugacguuuucaccgugagcugcagaguacugacaaggccgaguccugauuuugacuucauuuuucucgugcccccaaccgucgaaucccggacuaaaccuuucucugugcccguuuuaacaguggaggaaaugaccaacagccgcuuuccaaucccccuggagaaacuuuucacgggaccuuccucagccuucgucgugcagccacagaaugguagauguacuaccgauggcguauugcuggggacaacucaacuaaguccgguuaacauuugcaccuuuaggggagacgugacacauaucaccggcagccacaauuacacgaugaaccucgcaucucagaauuggaacaauuaugaucccacugaggaaauaccugcuccacuggguacacccgacuucgucgggaagauucagggagugcuuacccagacuacacggaccgacggcuccacgcgcggccauaaggccaccgucuacacagggucagcugauuuugccccuaagcugggacgagugcaauucgagacugacaccaaccacgauuuugaagcaaaucagaacacaaaauucacuccaguuggugugauccaggacggcagcaccacacacagaaaugagccccaacaguggguauugccgaguuacucugggaggaacacccauaauguccaccucgccccugcuguggcgccaacuuuucccggagaacagcuguuauucuuucgguccacgaugccuggcuguagcgguuaucccaacauggaucuggacugccuccuuccacaggaguggguucaauacuucuaucaggaggcagccccugcucagucggauguggcccuguugcguuuugucaaucccgacacagggcgcgugcuauucgaauguaagcugcauaaaucuggcuacguaaccguggcacacacuggacagcacgaucucguuauuccaccgaacggcuauuuuagauucgacuccugggucaaccaauucuacacccuggccccuauggggaauggaacagguaggcggcgagcuguguga

SEQ ID NO: 18589 - RNA, 1623 nt, Artificial Sequence; identical to SEQ ID NO: 18584
  derived and/or modified sequence opt3 from VP1__Norovirus__AJA71408

SEQ ID NO: 18590 - RNA, 1623 nt, Artificial Sequence; identical to SEQ ID NO: 18581
  derived and/or modified sequence opt3 from VP1__Norovirus__AJA71409

SEQ ID NO: 18591 - RNA, 1623 nt, Artificial Sequence
  derived and/or modified sequence opt3 from VP1__Norovirus__AJA71410
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacugauagagacuuugaagcaaaccagaauaccaaauucacaccaguuggugugauccaggauggcgggacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggaccuggauugccuccuuccucaggaguggguucaauacuucuaucaggaggcagcccccgcucagucggacguggcccuguugcgcuuugucaacccagauacgggcagagugcuauucgaauguaagcugcauaaaucuggauacguaacaguggcacacaccggccagcaugaccucguuauuccgccuaauggguauuuuagguucgauuccugggucaaccaauucuacacucuggcccccaugggaaacgguaccggccggcgacgcgcucuuuga

SEQ ID NO: 18592 - RNA, 1623 nt, Artificial Sequence; identical to SEQ ID NO: 18508
  derived and/or modified sequence opt3 from VP1__Norovirus__AJA71411

SEQ ID NO: 18593 - RNA, 1623 nt, Artificial Sequence
  derived and/or modified sequence opt3 from VP1__Norovirus__AJA71412
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggaccuggauugccuccuuccucaggaguggguucaauacuucuaucaggaggcagcccccgcucagucggacguggcccuguugcgcuuugucaacccagauacgggcagagugcuauucgaauguaagcugcauaaaacaggauacguaaccguggcacacacuggccagcaugaccucguuauuccgccuaauggguauuuuagguucgauucuugggucaaccaauucuacacccuggcccccaugggaaacgguacaggccggcgacgcgcucuuuga

SEQ ID NO: 18594 - RNA, 1623 nt, Artificial Sequence; identical to SEQ ID NO: 18313
  derived and/or modified sequence opt3 from VP1__Norovirus__AJA71413

SEQ ID NO: 18595 - RNA, 1623 nt, Artificial Sequence; identical to SEQ ID NO: 18265
  derived and/or modified sequence opt3 from VP1__Norovirus__AJA71416

SEQ ID NO: 18596 - RNA, 1623 nt, Artificial Sequence
  derived and/or modified sequence opt3 from VP1__Norovirus__AJA71417
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucacgucucagaacugguccaauuaugaucccacugaggaaauaccugcaccacuggguacacccgacuucgucgggaagauucagggaaugcuuacccagacuacacgcaccgacggcucaacgcgaggccacaaggcuaccguguacacagggagcgccgauuuugcuccuaagcugggaagaguccaauucgagacugacaccgaucaugacuuugaagccaaccagaauacaaaauucacuccaguggguguuauccaggauggcaguaccacacacaggaacgagccccaacaguggguguugccgucuuacuccgggcggaauaccccuaacguacaccucgcaccagccgucgcucccacuuuuccuggagaacagcuguuauucuuucguagcacgaugcccggcuguucggguuauccaaauauggaccuggauugccuccuuccucaggagugggugcaauacuucuaucaggaggcggcacccgcccagucugacguugcucuguugcgcuuugugaacccagauacagggagaguccuauucgaauguaagcugcauaaauccggcuacgugaccguagcccacacuggacagcaugaccucgugauuccgccuaauggcuauuuuagguucgauucauggguuaaccaauucuacacccuggcacccauggggaacggaacaggucggcgacgcgcccuuuga

SEQ ID NO: 18597 - RNA, 1623 nt, Artificial Sequence
  derived and/or modified sequence opt3 from VP1__Norovirus__AJA71418
augaagauggccagcuccgacgcuucucccucagauggcagugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgucuuacuccggacggaacacaccuaauguccaccucgccccagcuguggcgcccaccuuuccuggcgaacagcuguuauucuuucguagcacuaugcccgguuguucgggguauccaaacauggaccuggauugccuccuuccucaggaguggguucaauacuucuaucaggaggcagcccccgcucagucugacguggcccuguugcgcuuugucaauccagauacgggcagagugcuauucgaauguaagcugcauaaauccggauacguaacaguggcacacaccggccagcaugaccucguuauuccgccuaacggguauuuuagguucgauucaugggucaaucaauucuacacucuggcccccaugggaaacgguaccggccggcgacgcgcucuuuga

SEQ ID NO: 18598 - RNA, 1623 nt, Artificial Sequence; identical to SEQ ID NO: 18597
  derived and/or modified sequence opt3 from VP1__Norovirus__AJA71419

SEQ ID NO: 18599 - RNA, 1623 nt, Artificial Sequence; identical to SEQ ID NO: 18313
  derived and/or modified sequence opt3 from VP1__Norovirus__AJA71420

SEQ ID NO: 18600 - RNA, 1623 nt, Artificial Sequence; identical to SEQ ID NO: 18508
  derived and/or modified sequence opt3 from VP1__Norovirus__AJA71421

SEQ ID NO: 18601 - RNA, 1623 nt, Artificial Sequence; identical to SEQ ID NO: 18584
  derived and/or modified sequence opt3 from VP1__Norovirus__AJA71422

SEQ ID NO: 18602 - RNA, 1623 nt, Artificial Sequence
  derived and/or modified sequence opt3 from VP1__Norovirus__AJA71423
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggaaugcuuacacagaccacucgcacagacggcucaacccgaggccacaaggccacgguguacaucgggggagcugauuuugccccuaagcuggguagaguccaauucgagaccgacacagaucaugacuuugaagcaaaccagaauacuaaauucaccccagugggcguuauucaggaugggagcacaacucacaggaacgagccccaacaguggguguugccgaguuacucuggacggaauaccccuaacguacaccucgccccagcugucgcgcccacauuuccuggcgaacagcuguuauucuuucguuccaccaugcccgguuguagcggguauccaaauauggaccuggauugccuccuuccucaggagugggugcaauacuucuaucaggaggcagcccccgcucagucggacguugcccuguugcgcuuugugaacccagauacuggcagaguccuauucgaauguaagcugcauaaaucuggauacgugacgguagcacacacaggccagcaugaccucgugaucccgccuaauggguauuuuagguucgauuccuggguuaaccaauucuacacccuggcccccaugggaaacgguacuggccggcgacgcgcucuuuga

SEQ ID NO: 18603 - RNA, 1623 nt, Artificial Sequence
  derived and/or modified sequence opt3 from VP1__Norovirus__AJA71424
augaagauggccagcuccgacgcuaaccccucugauggcucagcagccaaucuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggaaugcuuacacagaccacucgcacagacggcagcacccgaggccacaaggccacgguguacaccgggagugcugauuuugccccuaagcugggaagaguccaauucgagacagacacugaucaugacuuugaagcaaaucagaacaccaaauucacaccaguggguguuauccaggauggcucuacuacccacaggaaugagccccaacaguggguguugccguccuacagcgggcggaacacaccuaauguacaccucgccccagcugucgcgcccaccuuuccuggagaacagcuguuauucuuucguucgacuaugcccggcuguucugguuauccaaacauggaccuggauugccuccuuccucaggagugggugcaauacuucuaucaggaggcagcccccgcucaguccgacguugcccuguugcgcuuugugaauccagauacggggagaguccuauucgaauguaagcugcauaaaucaggcuacgugacaguagcacacaccggacagcaugaccucgugauuccgccuaacggcuauuuuagguucgauaguuggguuaaucaauucuacacucuggcccccauggggaacggaaccggucggaagcgagcucuuuga

SEQ ID NO: 18604 - RNA, 1623 nt, Artificial Sequence
  derived and/or modified sequence opt3 from VP1__Norovirus__AJA71425
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccagucccccuggagaaacuuuucaccggaccuuccucagccuucgugguacagccacagaacgguagauguacgacugauggcguuuugcuggggaccacacaacuaaguccggugaauaucugcacuuuuaggggagacgucacccauauuacaggcagccacaacuacaccaugaaucucgcaucucagaacugguccaauuaugaucccacggaggaaaucccugcuccacuggguacucccgacuucguggggaagauacagggaguccuuacacagaccacucggacagacggcucaacccgcggccauaaggccacgguguacaccgggagcgcugauuuugccccuaagcugggacgaguucaauucgagacagacacugauagagacuuugaagcaaaccagaauaccaaauucacaccaguggguguaauucaggauggcgggacuacccacaggaacgagccccaacagugggucuugccgaguuacucuggacggaauacaccuaacgugcaccucgccccagcuguugcgcccaccuuuccuggcgaacagcuguuauucuuucguuccacuaugcccgguuguagcggguauccaaauauggaccuggauugccuccuuccucaggagugggugcaauacuucuaucaggaggcagcccccgcucagucggacgucgcccuguugcgcuuugugaacccagauacgggcagaguacuauucgaauguaagcugcauaaaucuggauacgugacaguugcacacaccggccagcaugaccucgucaucccgccuaauggguauuuuagguucgauuccugggugaaccaauucuacacucuggcccccaugggaaacgguaccggccggcgacgcgcucuuuga

SEQ ID NO: 18605 - RNA, 1623 nt, Artificial Sequence
  derived and/or modified sequence opt3 from VP1__Norovirus__AJA71426
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccucauaugaucccacggaggaaauaccugcuccacuggguacucccgacuucgucgggaagauucagggaaugcuuacacagaccacucgcacagacggcagcacccgaggccacaaggccacgguguacaccgggagugcugauuuugccccuaagcugggaagaguccaauucgagacagacacugaucaugacuuugaagcaaaucagaacaccaaauucacaccaguggguguuauccaggauggcucuacuacccacaggaaugagccccaacaguggguguugccguccuacagcgggcggaacacaccuaauguacaccucgccccagcugucgcgcccaccuuuccuggagaacagcuguuauucuuucguucgacuaugcccggcuguucugguuauccaaacauggaccuggauugccuccuuccucaggagugggugcaauacuucuaucaggaggcagcccccgcucaguccgacguugcccuguugcgcuuugugaauccagauacggggagaguccuauucgaauguaagcugcauaaaucaggcuacgugacaguagcacacaccggacagcaugaccucgugauuccgccuaacggcuauuuuagguucgauaguuggguuaaucaauucuacacucuggcccccauggggaacggaaccggucggcgacgcgcucuuuga

SEQ ID NO: 18606 - RNA, 1623 nt, Artificial Sequence
  derived and/or modified sequence opt3 from VP1__Norovirus__AJA71427
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugggguaauuaugaucccacggaggaaauaccugcuccacuggggacucccgacuucgucggaaagauucagggcgugcuuacacagaccacucgcacagacggcuccacccgagggcacaaggccacggucuacaccggaucagcugauuuugccccuaagcuggguagagugcaauucgagacagacacugaucaugacuuugaagcaaaccagaauaccaaauucacaccaguuggcgugauccaggaugggagcacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggaccuggauugccuccuuccucaggaguggguucaauacuucuaucaggaggcagcccccgcucagucggacguggcccuguugcgcuuugucaacccagauacgggcagagugcuauucgaauguaagcugcauaaaucuggauacguaacaguggcacacaccggccagcaugaccucguuauuccgccuaauggguauuuuagguucgauuccugggucaaccaauucuacacucuggcccccaugggaaacgguaccggccggcgacgcgcucuuuga

SEQ ID NO: 18607 - RNA, 1623 nt, Artificial Sequence; identical to SEQ ID NO: 18591
  derived and/or modified sequence opt3 from VP1__Norovirus__AJA71428

SEQ ID NO: 18608 - RNA, 1623 nt, Artificial Sequence
  derived and/or modified sequence opt3 from VP1__Norovirus__AJA71429
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucauaguucagccacagaacgguagauguacuaccgauggcguguugcuggggacaacucaacuaaguccggucaauauuugcaccuuuaggggagacgugacacauaucagcggcucucggaacuacaccaugaaucucgccucccagaacuggaacucauaugaucccacggaggaaacuccugcaccacuggguacacccgacuucguagggaagauucagggaguucuuacccagacuacacgcaccgacggcagcacgcgaggccacaaggcuaccguguacacagggagugccgauuuuucuccuaagcugggaagaguccaauucgcuacugacaccgauaaugacuuugugacaaaucagaacacuaaauucaccccagucggugugauccaggauggcuccacaacccccaggaaugagccgcaacaguggguuuugccuagcuacucggggcggaacacucauaaugugcaccucgccccagcaguagcccccacguuuccuggagaacagcuguuauucuuucguucuacaaugcccggcuguuccgguuauccaaacauggaccuggauugccuccuuccucaggaguggguccaauacuucuaucaggaagcugcgcccgcacagucagacguggcccuguugcgcuuuguuaauccagauaccgggagagugcuauucgaguguaagcugcacaaaacuggcuacgucaccguggcucauacaggacagcacgaccucguaaucccgccuaacggcuauuuuagguucgauaguugggugaaccaauucuacacccuggcccccauggggaauggaacuggucggcgacgcguucuuuga

SEQ ID NO: 18609 - RNA, 1623 nt, Artificial Sequence
  derived and/or modified sequence opt3 from VP1__Norovirus__AJA71430
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacuaaccacgauuuugacgcaaaucagaacaccaaauucacaccaguuggugugauccaggauggcgggacuacccacagaaaugaaccccaacaguggguauugccgaguuacucuggaaggaacacaccuaauguccaucucgccccagcuguggcgcccaccuuuccuggcgagcagcuguuauucuuucgguccacuaugcccgguuguagcggguauccaaacauggaccuggauugccuccuuccucaggaauggguucaauacuucuaucaggaggcagcccccgcucagucggacguggcccuguugcguuuugucaauccagauacgggccgcgugcuauucgaguguaagcugcacaaaucuggauacguaacaguggcacauaccggccagcacgaccucguuauuccgccuaacggguauuuuagauucgauuccugggucaaccaauucuacacucuggcccccaugggaaaugguaccggcaggcggcgagcucuuuga

SEQ ID NO: 18610 - RNA, 1623 nt, Artificial Sequence
  derived and/or modified sequence opt3 from VP1__Norovirus__AJA71456
augaagauggccagcuccgacgcuaaccccucugauggcucagcagccaaucuggugccugaggucaacaaugaaguuauggcgcucgagccagugguaggggcuaccaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaagugaucuucgcugccguaccuccaaauuuuccgacggagggccucucucccucgcagguuaccauguucccucauauuguggucgacgugcgccaacuggagccagugcuuaucccccugccugauguccgaaacaauuuuuaucacuacaaccagucaaaugacccaacaauaaaguugaucgcaaugcucuauacuccccugcgugcuaacaacgccggggaugacguuuucaccgugagcugcagaguacugacaaggccgaguccugauuuugacuucauuuuucucgugcccccaaccgucgaaucccggacuaaaccuuucucugugcccaucuuaacaguugaggaaaugaccaauagccgcuuuccaauuccccuggagaaacuuuucacgggaccuuccucagcguucgugguccagccacagaacgguagauguacuaccgauggcguguugcuggggacaacucaacuaaguccgguaaauaucugcaccuuuaggggagacguuacacauauaaccggcagccggaacuacacgaugaaucucgccucucagaacugguccaauuaugaucccacugaggaaauuccugcaccacuggguauccccgacuucguggggaagauucagggaaugcuuacacagaccacucgcacagacggcucaacccgaggccacaaggcuacggucuacaccgggagcgccgauuuugcuccuaagcugggaagagugcaauucgagacagacacugaucaugacuuugaagccaaccagaauaccaaauucacaccagucggugugauccaggauggcaguacuacccacaggaacgagccccaacaguggguuuugccgucuuacuccgggcggaauacaccuaacgugcaccucgcaccagccguagcucccaccuuuccuggagaacagcuguuauucuuucguagcacuaugcccggcuguucggguuauccaaauauggaccuggauugccuccuuccucaggaguggguccaauacuucuaucaggaggcggcacccgcccagucugacguggcucuguugcgcuuuguuaacccagauacggggagagugcuauucgaauguaagcugcauaaauccggcuacgucacaguggcccacaccggacagcaugaccucguaaucccgccuaauggcuauuuuagguucgauucaugggugaaccaauucuacacucuggcacccauggggaacggaaccggucggcgacgcgcccuuuga

SEQ ID NO: 18611 - RNA, 1623 nt, Artificial Sequence
  derived and/or modified sequence opt3 from VP1__Norovirus__AJA71457
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcaguacuacccacaggaacgagccccaacaguggguauugccgucuuacuccgggcggaauacaccuaacguccaccucgccccagcuguggcgcccaccuuuccuggagaacagcuguuauucuuucguagcacuaugcccggcuguucggguuauccaucuauggaccuggauugccuccuuccucaggaguggguucaauacuucuaucaggaggcagcccccgcucaguccgacguggcccuguugcgcuuugucaauccagauacggggagagugcuauucgaauguaagcugcauaaaucaggcuacguaacaguggcacacaccggacagcaugaccucguuauuccgccuaacggcuauuuuagguucgauaguugggucaaucaauucuacacucuggcccccauggggaacggaaccggucggcgacgcgcucuuuga

SEQ ID NO: 18612 - RNA, 1623 nt, Artificial Sequence
  derived and/or modified sequence opt3 from VP1__Norovirus__AJA71458
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccgcugaggaaauaccugccccacuggguacgcccgacuucgucgggaagauucagggagugcuuacucagacaacccggacugacggcucaacacgcggccauaaggcuaccgucuacacggggagcgccgauuuugcaccuaagcugggacgagugcaauucgagaccgacacagauagagacuuugaagccaaccagaauacuaaauucaccccaguuggugugauccaggauggcgggacaacucacaggaacgagccccaacaguggguauugccgaguuacucuggacggaauaccccuaacguccaccucgcuccagcgguggcacccacauuuccuggcgaacagcuguuauucuuucguuccaccaugcccgguuguagcggguauccaaauauggaccuggauugccuccuuccucaggaguggguucaauacuucuaucaggaggccgcucccgcccagucggacguggcacuguugcgcuuugucaacccagauacuggcagagugcuauucgaauguaagcugcauaaaucuggauacguaacgguggcccacacaggccagcaugaccucguuauuccgccuaauggguauuuuagguucgauuccugggucaaccaauucuacacccuggcucccaugggaaacgguacuggccggcgacgcgcccuuuga

SEQ ID NO: 18613 - RNA, 1623 nt, Artificial Sequence
  derived and/or modified sequence opt3 from VP1__Norovirus__AJA71459
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcguggauuuugcuccuaagcugggaagaguucaauucgagacagacacugaucaugacuuugaagccaaccagaauaccaaauucacaccaguggguguaauccaggauggcaguacuacccacaggaacgagccccaacagugggucuugccgucuuacuccgggcggaauacaccuaacgugcaccucgcaccagccguugcucccaccuuuccuggagaacagcuguuauucuuucguagcacuaugcccggcuguucggguuauccaaauauggaccuggauugccuccuuccucaggagugggugcaauacuucuaucaggaggcggcacccgcccagucugacgucgcucuguugcgcuuugugaacccagauacggggagaguacuauucgaauguaagcugcauaaauccggcuacgugacaguugcccacaccggacagcaugaccucgucauuccgccuaauggcuauuuuagguucgauucaugggugaaccaauucuacacucuggcacccauggggaacggaaccggucggcgacgcgcccuuuga

SEQ ID NO: 18614 - RNA, 1623 nt, Artificial Sequence; identical to SEQ ID NO: 18584
  derived and/or modified sequence opt3 from VP1__Norovirus__AJA71460

SEQ ID NO: 18615 - RNA, 1623 nt, Artificial Sequence; identical to SEQ ID NO: 18313
  derived and/or modified sequence opt3 from VP1__Norovirus__AJA71461

SEQ ID NO: 18616 - RNA, 1623 nt, Artificial Sequence; identical to SEQ ID NO: 18587
  derived and/or modified sequence opt3 from VP1__Norovirus__AJA71462

SEQ ID NO: 18617 - RNA, 1623 nt, Artificial Sequence; identical to SEQ ID NO: 18597
  derived and/or modified sequence opt3 from VP1__Norovirus__AJA71463

SEQ ID NO: 18618 - RNA, 1623 nt, Artificial Sequence; identical to SEQ ID NO: 18591
  derived and/or modified sequence opt3 from VP1__Norovirus__AJA71464

SEQ ID NO: 18619 - RNA, 1623 nt, Artificial Sequence; identical to SEQ ID NO: 18591
  derived and/or modified sequence opt3 from VP1__Norovirus__AJA71465

SEQ ID NO: 18620 - RNA, 1623 nt, Artificial Sequence
  derived and/or modified sequence opt3 from VP1__Norovirus__AJA71466
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaaccuugugcaggcaccugguggcgaguucaccguuaguccaaggaaugcccccggggaaauccuguggagcgcuccuuugggaccagaauuaaaccccuaccugucccaccuagcccggauguauaauggcuacgcggguggguuugaggugcaggucauucucgcaggaaacgccuucacagcuggcaaagugaucuuugccgcaguaccuccaaauuucccgacugagggccugucucccucgcagguuacgauguuuccucauauuguggucgaugugcgccaacuugaaccagugcugauccccuugccugacguccgaaacaauuucuaucacuacaaccagucaaaugauccaaccauaaagcucaucgcuaugcuguauacaccccugcgugccaacaacgcgggggacgauguuuuuacugugagcugcagaguacucaccaggccgaguccugacuucgauuuuauuuucuuagugcccccaacagucgagucccggaccaaaccuuuuucugugcccguucugacuguggaagagaugacaaauagccgcuucccaaucccccuugagaaguuguuuaccggaccuuccucagccuucgucgugcagccacagaacgguagauguacgacugacggcguacugcuagggaccacacaacucaguccgguuaauauuugcacuuucaggggagaugugacccauaucacaggcagccggaacuacaccaugaaucuggcaucucagaacugguccaauuaugaccccacggaagagauaccugcuccacuugguacucccgauuuugucgggaaaauucagggagugcugacacagaccacucgcacagacggcucaacccgaggccacaaggccacggucuacaccgggagcgcugacuucgccccuaaguugggaagagugcaauuugaaacagauacugacagggauuucgaggcaaaccagaauaccaaauuuacaccaguuggugugauccaggacggcaguacuacccaucggaacgaaccccaacaguggguacucccgucuuacuccgggcguaauacaccuaacguccaccuggccccagcuguggcgcccaccuucccuggagagcaguuacuguuuuuccgcagcacuaugcccggcuguucggguuauccaaauauggaucucgacugccuucugccucaggaguggguucaauacuuuuaucaggaagcagcccccgcucagucugauguggccuugcuaagauucgucaacccagacacggggagggugcuguuugaguguaagcuccacaaauccggcuacguaacaguggcacauaccggacagcacgaucugguuauuccgccuaauggcuauuuccgguuugacucaugggucaaccaauucuacacucuugcccccauggggaacggaaccggucgacgcagagcucuguga

SEQ ID NO: 18621 - RNA, 1623 nt, Artificial Sequence
  derived and/or modified sequence opt3 from VP1__Norovirus__AJA71467
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccagguucacaccaguuggugugauccaggauggcgggacuacccaccggaaugagccccaacaguggguauugccgagcuacaguggacguaacacaccuaauguccaccucgccccagcuguggcgcccaccuuuccuggcgaacagcuguuauucuuucgcucuacuaugcccgguuguuccggguauccaaacauggaccuggauugccuccuuccucaggaguggguucaacauuucuaccaggaggcagcccccgcucagagcgacguggcccuguugagauuugucaauccagauacgggcagggugcuauucgaauguaaacugcacaagucgggauauguaacaguggcacauaccggccagcacgaccucguuauuccgccuaacggguacuuucgguucgauucuugggucaaccaauucuauacucuggcccccaugggaaaugguaccggccgacgcagagcucuuuga

SEQ ID NO: 18622 - RNA, 1623 nt, Artificial Sequence
  derived and/or modified sequence opt3 from VP1__Norovirus__AJA71470
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccaucuuaacuguugaggaaaugacaaauagccgcuuuccaauuccccuggagaaacuuuucaccggaccuuccucagccuucgugguccagccacagaacgguagauguacgacugauggcguguugcuggggaccacacaacuaaguccgguaaauaucugcacuuuuaggggagacguuacccauauaacaggcagccggaacuacaccaugaaucucgcaucucagaacugguccaauuaugaucccacggaggaaauuccugcuccacuggguauccccgacuucguggggaagauucagggaaugcuuacucagacaacccgcacugacggcucaacacgaggccacaaggccaccgucuacacggggagcgcugauuuugccccuaagcugggaagagugcaauucgagaccgacacagaucaugacuuugaagcaaaccagaauacuaaauucaccccagucggugugauccaggauggcaguacaacucacaggaacgagccccaacaguggguuuugccgucuuacuccgggcggaauaccccuaacgugcaccucgccccagcuguagcgcccacauuuccuggagaacagcuguuauucuuucguagcaccaugcccggcuguucggguuauccaaauauggaccuggauugccuccuuccucaggaguggguccaauacuucuaucaggaggcagcccccgcucagucugacguggcccuguugcgcuuuguuaacccagauacugggagagugcuauucgaauguaagcugcauaaauccggcuacgucacgguggcacacacaggacagcaugaccucguaaucccgccuaauggcuauuuuagguucgauucaugggugaaccaauucuacacccuggcccccauggggaacggaacuggucggcgacgcgcucuuuga

SEQ ID NO: 18623 - RNA, 1623 nt, Artificial Sequence
  derived and/or modified sequence opt3 from VP1__Norovirus__AJA71471
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagaauugaaccccuacuuaucccaccuggcccggauguauaauggcuacgcggguggguucgaggugcaggucauucuagcaggaaacgccuuuacagcuggcaaagugaucuucgccgcaguaccuccaaauuuuccgacugagggccucucucccucgcagguuacgauguucccucauauuguggucgaugugcgccaacuggaaccagugcuuaucccccugccugacguccgaaacaauuuuuaucacuacaaccagucaaaugauccaaccauaaaguugaucgcuaugcucuauacaccccugcgugccaacaacgcgggggacgauguuuucacugugagcugcagaguacugaccaggccgaguccugacuuugauuucauuuuucucgugcccccaacagucgagucccggaccaaaccuuucucugugcccguuuuaacuguggaagagaugacaaauagccgcuuuccaaucccccuggagaaacuuuucaccggaccuuccucagccuucgucgugcagccacagaacgguagauguacgacugacggcguauugcuggggaccacacaacuaaguccgguuaauauuugcacuuuuaggggagaugugacccauaucacaggcagccggaacuacaccaugaaucucgcaucucagaacugguccaauuaugaccccacggaagagauaccugcuccacuggguacucccgauuucgucgggaagauucagggagugcuuacacagaccacucgcacagacggcucaacccgaggccacaaggccacggucuacaccgggagcgcugacuuugccccuaagcugggaagagugcaauucgaaacagauacugacagggauuuugaggcaaaccagaauaccaaauucacaccaguuggugugauccaggacggcaguacuacccaucggaacgaaccccaacaguggguauugccgucuuacuccgggcguaauacaccuaacguccaccucgccccagcuguggcgcccaccuuuccuggagagcagcuguuauucuuucgcagcacuaugcccggcuguucggguuauccaaauagagaucuggacugccuccuuccucaggaguggguucaauacuucuaucaggaagcagcccccgcucagucugauguggcccuguugagguuugucaacccagacacggggcgggugcuauucgaguguaagcugcacaaauccggcuacguaacaguggcacauaccggacagcacgaucucguuauuccgccuaauggcuauuuucgauucgacucaugggucaaccaauucuacacucuggcccccauggggaacggaaccggucgcagaagggcucuuuga

SEQ ID NO: 18624 - RNA, 1623 nt, Artificial Sequence
  derived and/or modified sequence opt3 from VP1__Norovirus__AJA71472
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagaauugaaccccuacuuaucccaccuggcccggauguauaauggcuacgcggguggguucgaggugcaggucauucuagcaggaaacgccuuuacagcuggcaaagugaucuucgccgcaguaccuccaaauuuuccgacugagggccucucucccucgcagguuacgauguucccucauauuguggucgaugugcgccaacuggaaccagugcuuaucccccugccugacguccgaaacaauuuuuaucacuacaaccagucaaaugauccaaccauaaaguugaucgcuaugcucuauacaccccugcgugccaacaacgcgggggacgauguuuucacugugagcugcagaguacugaccaggccgaguccugacuuugauuucauuuuucucgugcccccaacagucgagucccggaccaaaccuuucucugugcccguuuuaacuguggaagagaugacaaauagccgcuuuccaaucccccuggagaaacuuuucaccggaccuuccucagccuucgucgugcagccacagaacgguagauguacgacugacggcguauugcuggggaccacacaacuaaguccgguuaauauuugcacuuuuaggggagaugugacccauaucacaggcagccggaacuacaccaugaaucucgcaucucagaacugguccaauuaugaccccacggaagagauaccugcuccacuggguacucccgauuucgucgggaagauucagggagugcuuacacagaccacucgcacagacggcucaacccgaggccacaaggccacggucuacaccgggagcgcugacuuugccccuaagcugggaagagugcaauucgaaacagauacugacagggauuuugaggcaaaccagaauaccaaauucacaccaguuggugugauccaggacggcaguacuacccaucggaacgaaccccaacaguggguauugccgucuuacuccgggcguaauacaccuaacguccaccucgccccagcuguggcgcccaccuuuccuggagagcagcuguuauucuuucgcagcacuaugcccggcuguucggguuauccaaauauggaucuggacugccuccuuccucaggaguggguucaauacuucuaucaggaagcagcccccgcucagucugauguggcccuguugagauuugucaacccagacacggggagggugcuauucgaguguaagcugcacaaauccggcuacguaacaguggcacauaccggacagcacgaucucguuauuccgccuaauggcuauuuucgguucgacucaugggucaaccaauucuacacucuggcccccauggggaacggaaccggucgacgcagagcucuuuga

SEQ ID NO: 18625 - RNA, 1623 nt, Artificial Sequence
  derived and/or modified sequence opt3 from VP1__Norovirus__AJA71473
augaagauggccagcuccgacgcuucucccucagauggcagugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugauagggacuuugaagcaaaucagaacaccaaauucacaccaguuggugugauccaggauggcgggacuacccaucggaaugagccccaacaguggguauugccgucuuacuccggacguaacacaccuaauguccaccucgccccagcuguggcgcccaccuuuccuggcgaacagcuguuauucuuucgcagcacuaugcccgguuguucgggguauccaaacauggaccuggauugccuccuuccucaggaguggguucaauacuucuaucaggaggcagcccccgcucagucugacguggcccuguugagauuugucaauccagauacgggcagggugcuauucgaauguaagcugcacaaauccggauacguaacaguggcacauaccggccagcacgaccucguuauuccgccuaacggguauuuucgguucgauucaugggucaaucaauucuacacucuggcccccaugggaaacgguaccggccgacgcagagcucuuuga

SEQ ID NO: 18626 - RNA, 1623 nt, Artificial Sequence
  derived and/or modified sequence opt3 from VP1__Norovirus__AJA71474
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaagcaaaccagaauaccaaauucacaccaguuggugugauccaggauggcgggacuacccaucggaacgagccccaacaguggguauugccgaguuacucuggacguaauacaccuaacguccaccucgccccagcuguggcgcccaccuuuccuggcgaacagcuguuauucuuucgcuccacuaugcccgguuguagcggguauccaaauacggaccuggauugccuccuuccucaggaguggguucaauacuucuaucaggaggcagcccccgcucagucggacguggcccuguugagauuugucaacccagauacaggcagggugcuauucgaauguaagcugcacaaaucuggauacguaaccguggcacauacuggccagcacgaccucguuauuccgccuaauggguauuuucgguucgauuccugggucaaccaauucuacacccuggcccccaugggaaacgguacaggccgacgcagagcucuuuga

SEQ ID NO: 18627 - RNA, 1623 nt, Artificial Sequence; identical to SEQ ID NO: 18508
  derived and/or modified sequence opt3 from VP1__Norovirus__AJA71475

SEQ ID NO: 18628 - RNA, 1623 nt, Artificial Sequence; identical to SEQ ID NO: 18587
  derived and/or modified sequence opt3 from VP1__Norovirus__AJA71476

SEQ ID NO: 18629 - RNA, 1623 nt, Artificial Sequence
  derived and/or modified sequence opt3 from VP1__Norovirus__AJF21974
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcgcgucauucuagcaggaaacgccuuuacagcuggcaaagugaucuucgccgcaguaccuccaaauuuuccgacugagggccucucucccucgcagguuacgauguucccucauauuguggucgacgugcgacagcuggagccagugcuuaucccccugccugauguccguaacaauuuuuaucacuacaaccaaucaaaugacccaaccauaaaguugaucgcuaugcucuauacaccccugagagccaacaacgcgggggaugacguuuucacugugagcugcaggguacugacccggccgaguccugauuuugacuucauuuuucucgugcccccaacagucgaaucccgcaccaaaccuuucucugugcccaucuuaacuguugaggaaaugacaaauagcagauuuccaauuccccuggagaaacuuuucaccggaccuuccucagccuucgugguccagccacagaacgguagguguacgacugauggcguguugcuggggaccacacagcuaaguccgguaaauaucugcacuuuucggggagacguuacccauauaacaggcagccgcaacuacaccaugaaucucgcaucucaaaacugguccaauuaugaucccacggaggaaauuccugcuccacuggguauccccgacuucguggggaagauucagggaaugcuuacucagacaacccgaacugacggcucaacaagaggccacaaggccaccgucuacacggggagcgcugauuuugccccuaagcugggaagggugcaguucgagaccgacacagaucaugacuuugaagcaaaccaaaauacuaaauucaccccagucggugugauccaggauggcaguacaacucaccggaacgagccccagcaauggguuuugccgucuuacuccgggcguaauaccccuaacgugcaccucgccccagcuguagcgcccacauuuccuggagaacagcuguuauucuuucgcagcaccaugcccggcuguucggguuauccaaauauggaccuggauugccuccuuccucaggaguggguccaguacuucuaucaagaggcagcccccgcucagucugacguggcccuguugagauuuguuaacccagauacugggagggugcuauucgaauguaagcugcauaaauccggcuacgucacgguggcacacacaggacagcaugaccucguaaucccgccuaauggcuauuuucgguucgauucaugggugaaccaguucuacacccuggcccccauggggaacggaacuggucgacgcagagcucuuuga

SEQ ID NO: 18630 - RNA, 1623 nt, Artificial Sequence
  derived and/or modified sequence opt3 from VP1__Norovirus__AJF21975
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcuaacuuugccccuaagcugggaagagugcaauucgagacagauacugaccaugauuuugaagcaaaucagaacaccaaauucacaccaguuggugugauccaggacggcgggacuacccacaggaaugagccccaacaguggguauugccgaguuacucuggacggaacacaccuaauguccaccucgccccagcuguggcgcccaccuuuccuggcgaacagcuguuauucuuucguuccacuaugcccgguuguagcggguauccaaacauggaucuggacugccuccuuccucaggaguggguucaauacuucuaucaggaggcagcccccgcucagucggauguggcccuguugcgcuuugucaauccagacacgggcagagugcuauucgaauguaagcugcauaaaucuggauacguaacaguggcacacaccggccagcaugaucucguuauuccgccuaacggguauuuuagguucgacuccugggucaaccaauucuacacucuggcccccaugggaaaugguaccggccggcgacgcgcucuuuga

SEQ ID NO: 18631 - RNA, 1623 nt, Artificial Sequence; identical to SEQ ID NO: 18562
  derived and/or modified sequence opt3 from VP1__Norovirus__AJF21976

SEQ ID NO: 18632 - RNA, 1623 nt, Artificial Sequence
  derived and/or modified sequence opt3 from VP1__Norovirus__AJF21977
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacuaaccacgauuuugaagcaaaucagaacaccaaauucacaccaguuggugugauccaggacggcaguacuacccacagaaaugagccccaacaguggguauugccgucuuacuccgggaggaacacaccuaauguccaucucgccccagcuguggcgcccaccuuuccuggagaacagcuguuauucuuucggagcacuaugcccggcuguucggguuauccaaacauggaucuggacugccuccuuccucaggaguggguucaauacuucuaucaggaggcagcccccgcucagucugauguggcccuguugcguuuugucaauccagacacggggcgcgugcuauucgaauguaagcugcacaaauccggcuacguaacaguggcacauaccggacagcacgaucucguuauuccgccuaacggcuauuuuagauucgacucaugggucaaccaauucuacacucuggcccccauggggaauggaaccgguaggcggcgagcucuuuga

SEQ ID NO: 18633 - RNA, 1623 nt, Artificial Sequence
  derived and/or modified sequence opt3 from VP1__Norovirus__AJF21978
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaaaccaaccagaauacaaaauucacuccaguuggugugauccaggauggcgggaccacacacaggaacgagccccaacaguggguauugccgaguuacucuggacggaauaccccuaacguccaccucgcaccagccguggcucccacuuuuccuggcgaacagcuguuauucuuucguuccacgaugcccgguuguagcggguauccaaauacagaccuggauugccuccuuccucaggaguggguucaauacuucuaucaggaggcggcacccgcccagucggacguggcucuguugcgcuuugucaacccagauaccggcagagugcuauucgaauguaagcugcauaaaucuggauacguaacuguggcccacaccggccagcaugaccucguuauuccgccuaauggguauuuuagguucgauuccugggucaaccaauucuacacacuggcacccaugggaaacgguaccggccggcgacgcgcccuuuga

SEQ ID NO: 18634 - RNA, 1623 nt, Artificial Sequence
  derived and/or modified sequence opt3 from VP1__Norovirus__AJF21979
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacuaaccacgauuuugaagcaaaucagaacaccaaauucacaccaguuggugugauccaggacggcgggacuacccacagaaaugagccccaacaguggguauugccgaguuacucuggaaggaacacaccuaauguccaucucgccccagcuguggcgcccaccuuuccuggcgaacagcuguuauucuuucgguccacuaugcccgguuguagcggguauccaaacauggaucuggacugccuccuuccucaggaguggguucaauacuucuaucaggaggcagcccccgcucagucggauguggcccuguugcguuuugucaauccagacacgggccgcgugcuauucgaauguaagcugcacaaaucuggauacguaacaguggcacauaccggccagcacgaucucguuauuccgccuaacggguauuuuagauucgacuccugggucaaccaauucuacacucuggcccccaugggaaaugguaccggcaggcggcgagcucuuuga

SEQ ID NO: 18635 - RNA, 1623 nt, Artificial Sequence
  derived and/or modified sequence opt3 from VP1__Norovirus__AJF21980
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggaaugcuuacacagaccacucgcacagacggcuccacccgaggccacaaggccacgguguacaccgggucagcugauuuugccccuaagcugggaagaguccaauucgagacagacacugaucaugacuuugaagcaaaucagaacaccaaauucacaccaguggguguuauccaggauggcagcacuacccacaggaaugagccccaacaguggguguugccgaguuacucugggcggaacacacacaauguacaucucgccccugcugucgcgccaaccuuucccggagaacagcuguuauucuuucguuccacuaugccuggcuguagcgguuaucccaacauggaccuggauugccuccuuccacaggagugggugcaauacuucuaucaggaggcagccccugcucagucggacguugcccuguugcgcuuugugaaucccgauacggggagaguccuauucgaauguaagcugcacaaaucuggcuacgugacaguagcacauaccggacagcacgaccucgugauuccaccgaacggcuauuuuagguucgauuccuggguuaaccaauucuacacucuggccccuauggggaauggaaccggucggcgacgcgucguguga

SEQ ID NO: 18636 - RNA, 1623 nt, Artificial Sequence; identical to SEQ ID NO: 18622
  derived and/or modified sequence opt3 from VP1__Norovirus__AJF21981

SEQ ID NO: 18637 - RNA, 1623 nt, Artificial Sequence; identical to SEQ ID NO: 18591
  derived and/or modified sequence opt3 from VP1__Norovirus__AJF21982

SEQ ID NO: 18638 - RNA, 1623 nt, Artificial Sequence
  derived and/or modified sequence opt3 from VP1__Norovirus__AJF21983
augaagauggccagcuccgacgcuaaccccucugauggcucagcagccagucuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggaacaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuuaguccuaagcugggaagagugcaauucgagacagacacugauagggacuuugaagccaaccagaauaccaaauucacaccaguuggugugauccaggauggcgggacuacccaucggaacgagccccaacaguggguauugccgucuuacuccggacguaaugcaccuaacguccaccucgccccagcuguggcgcccacauuuccuggcgaacagcuguuauucuuucgcagcaccaugcccgguuguucgggguauccaaauauggaccuggauugccuccuuccucaggaguggguucaauacuucuaucaggaggcagcccccgcucagucugacguggcccuguugagauuugucaacccagauacuggcagggugcuauucgaauguaagcugcacaaauccggauacguaacgguggcacauacaggccagcacgaccucguuauuccgccuaauggguauuuucgguucgauucaugggucaaccaauucuacacccuggcccccaugggaaacgguacuggccgacgcagagcucuuuga

SEQ ID NO: 18639 - RNA, 1623 nt, Artificial Sequence
  derived and/or modified sequence opt3 from VP1__Norovirus__AJF21984
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucgggccgacggcucaacacgcggccauaaggcuaccgucuacacggggagcgccgauuuugcaccuaagcugggacgagugcaauucgagaccgacacaaaccacgauuuugaagccaaucagaacacuaaauucaccccaguuggugugauccaggacggcgggacaacucacagaaaugagccccaacaguggguauugccgaguuacucuggaaggaacaccccuaauguccaucucgcuccagcgguggcacccacauuuccuggcgaacagcuguuauucuuucgguccaccaugcccgguuguagcggguauccaaacauggaucuggacugccuccuuccucaggaguggguucaauacuucuaucaggaggccgcucccgcccagucggauguggcacuguugcguuuugucaauccagacacuggccgcgugcuauucgaauguaagcugcacaaaucuggauacguaacgguggcccauacaggccagcacgaucucguuauuccgccuaacggguauuuuagauucgacuccugggucaaccaauucuacacccuggcucccaugggaaaugguacuggcaggcggcgagcccuuuga

SEQ ID NO: 18640 - RNA, 1623 nt, Artificial Sequence
  derived and/or modified sequence opt3 from VP1__Norovirus__AKE37037
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcaaugaugcaccagggucuacucgggcucaacaggccuggguguccacauauucaccccaguucguaccuaaacuaggaagcguuaaccugcguauaagugacaaugaugacuuucaguuccaaccaaccaaguuuacgcccgugggugucaacgaugacgaugacggccacccguuccgccagugggaacucccuaauuacucuggggagcugacccuuaacaugaaucuggcuccacccguggccccuaacuuucccggagaacagcucuuguucuuuagauccuucgucccaugcagcggcgguuacaaccaggggauuaucgauugucugauuccucaagaguggauccagcauuuuuaucaggaaucggcacccucucaguccgacguggccuuaaucagguacguuaauccagauacaggccggacucuguucgaggcuaagcuacaccgaucaggauauauuaccguggcgcacaguggcgacuacccgcucguagucccugcaaacgggcauuuucgcuucgacagcugggugaaucaauucuauucccuggcccccaugggaacagguaacggcagaaggcgggcucaguga

SEQ ID NO: 18641 - RNA, 1632 nt, Artificial Sequence
  derived and/or modified sequence opt3 from VP1__Norovirus__AKM20815
augaugauggccagcaaggacgcucccaccaacauggauggcacauccggggcaggacagcuggugccugaggccaauacugcggaaccacucccgaucaaacccgucgcuggugccgcaacggccguugcuaccgcaggccaagugaacaugauugacccuuggauaaugaauaacuucguacaggccccacagggggaguuuacaaucucucccaauaacacuccuggagauauucuuuucgaccugcaguugggcccacacuuaaaucccuuucuggcucaucuaucaagaauguacaacgguuggguggggaauaugcaagucaggaucaugcucgccggaaacgcguucagugcaggcaagauuaucgugugcuguauaccuccaggcuuuagcucccagucuaucucgauugcccaggcuaccauguucccgcacguuaucgccgaugugcggguccuggaacccauugacgugccucuugaugacguacgcaauguucuguuucauaacaaugauaacccacagacaaugcgauugcucugcaugcuguauacuccccugcguucagggggaaccagcagugguacagacccuuucgugaucgcaggcagaguccucaccuguccaacgcccgauuuuuccuucuuauuucuggugccgccugacauagagcaaaggacuaaacccuucucugugccaaauauuccuaugaaccuuaugagcaacucccgggucucaauguugaucgaugggaugaugguuaguaaugaccagaaccaggugccccaguuucaaaauggacgcguaacccuggacggccagcuacaggguacaacuaccgugagcgcugccugcgucgcgagaaugagggggcggauuuucaacaauaacggaaauuacggcgugaaccucacagaacuggauggcaauccauaucacgccuucgacucucccgcaccucuuggguuuccagauuucggaaacugugaccugcauaugaccuuuguuaagaucaauccgaacgaguuguccucaggugaucccagcggcaaaguggucauccgcaguuacgacgcuacguucgccccucaccucgggacugugaagcuggagaaugaugacgaauuagcucgauuuguaggaaaggagguugugcuggaacucacaugggucucuaacagagagggcgccacccuuaaucugugggcagugccaaacuaugguuccagcuugacucaagccucgcagcuagcucccccuauuuacccacccggguucggcgaggcgauagucuauuuuacaucuaccuucccgacgguguccaacccuaaaguuccaugcacccugccccaggaauuugugucacacuucguaaaugagcaggcaccuacaaggggagaugccgcucuccugcauuacgucgaccccgauacucaccggaaccuuggcgaauuuaagauguacccagagggguauaugaccugugugccuaaugccggagguggcccccaaacacugccaaucaacgggguuuucguguuuauuaguugggucagccguuacuaucaguugaaaccggugggaacugcaggcgccgcucgcagacucggucugaggcgguccuga

SEQ ID NO: 18642 - RNA, 1623 nt, Artificial Sequence
  derived and/or modified sequence opt3 from vp1__Norovirus__AKM20818
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccuauccagggcauguuuaugucccccgacgugaaccagucaguccaauuccagaaugguagaugucagauagaugggcaacugcagggaacaacuccagugagucuuagccagcugugcaagauuaggggcaaaaccucuuccaacgcacggguuuugaaccucucagagguggacggcacacccuucaucccucuggaaagcccagcuccggucggguuucccgacuuaggagguugugauuggcacgugaauuucaguuuucagacccaagaccgcgauccuucucaguccguaacguucgccacuaacgacgcuagcuuuguuccauaucugggcucggugucuccccauaauggggagggauuccaggccggcgauauuaucgguucccucggguggaucucagcaccuagugacaacagccaguuuaaugucugggccauuccaaaguacggcuccucucuucccgaugugacacaccuggcuccggcggucuucccuccaggauuuggcgaagugauauuguauuucuacagcaccuuucccgggucaggacaaccuagucagcuacagguucccugccugcucccacaggaguucaucacucacuuuuguaacgagcaagcaccuauugccggugaagcugcccugcuucauuauguggaccccgauacaggccgaaaucugggggaguucaaguuguacccagacggauucaugaccugcguaccgaacuccgucagcucuggcccucagacgcuccccaucaaugguguguuuguuuucgugucaugggucaguagauuuuaccagcugaaaccaguggggaccgcaagcgccgcuaggcgguuaggccugcgucgcauauga

SEQ ID NO: 18643 - RNA, 1623 nt, Artificial Sequence
  derived and/or modified sequence opt3 from VP1__Norovirus__ALD83748
augaagauggccagcaacgacgcugcacccuccaaugauggcgccaccgggcuggugccugaggucaacaaugaaacacucccacuugagccgguugcgggagcugccaucgcagcccccgugacuggucagaacaauauuauagacccuuggaucagaacgaacuucguacaagcuccaaauggcgaauuuaccgugucucccaggaacucaccuggggagauucuguugaauuuagaacugggaccagaucuaaaccccuaccucgcacaccugagucggauguauaauggcuacgccgguggggucgaggugcagguucuucuggcuggaaacgccuucacagcgggcaaaaucuuguuugcagccgugccuccaaauuucccggucgaguuucucagccccgcucagauuacuaugcugccucaucugaucguggacguacgcacccucgaaccaauaaugauccccuuaccugauguucgaaacacauucuuucacuauaauaaccagccaaccaaccguaugagacugguggccaugcuuuacacucccuugagguccaauggcucuggggacgaugucuucacagugucgugccgggugcugacccgcccgacgccugacuuugaguucacuuaucuaguucccccaucagucgaaagcaagaccaaaccuuuuagucuccccauucugacaaucuccgagcuuacuaacucuagauucccagugcccguagauagccuguuuaccgcacaaaauaacaauuugaacgugcagugucagaauggaaggugcacacucgacggugagcugcagggcaccacgcaauuacagccuuccgggauuugugcuuuccggggaaagaucacugccgauguccgcccaaaccaugacgaucgauggcacaugcagcugacaaaucucaacggcaccccguucgaccccacugaagacgugccugcgccacuugguacacccgauuuuaccgggcuguuguucggaguugccucacagagaaaugugcaaccuaacccaaauacgaccagggcacaugaggcugucauaaguacaacuagcucucaguuugugcccaaacuaggcuccauuaacuucggcucaaccagcgaagacuuuaucguagggcagccgacaaaguucacuccuguuggaauuaagaucgaggauggucacgccuuugaccaauggacccugccacgguacaguggccaccucacacugaauaugaaccuugcucccccuguggcccccaacuucccaggggaacagcuguuguuuuuccguucuaaugucccuugcgcaggaggcaucuccgauggugugauugacugucuccugccccaggaguggauacagcauuuuuaucaagagagcgccccaucgcagucugaugucgcuuuaauccgcuacgugaacccggacaccgggagaacucuguucgaagcgaaacuacacaggacgggcuacauuacaguugcacauuccggagauuauccucucgugguacccucaaauggcuacuuucgguucgacaguugggucaaccaguucuauagccuggccccaauggggaccggaaauggucgacgcagagugcaguga

SEQ ID NO: 18644 - RNA, 1623 nt, Artificial Sequence
  derived and/or modified sequence opt3 from VP1__Norovirus__ALF12528
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucaacuuucgugguucagccacagaacgguagauguaccacagauggcguguugcuggggacuacccaacuaaguccggucaauauuugcacauuuaggggagacgugacccauaucgcgggcagccacaacuacacgaugaaucucgccucucagaacuggaacuccuaugaucccacugaggaaauuccugcaccacuggguacacccgacuucguagggaagauccagggaguucuuacccagacuacacggaccgacggcucaacgcgcggccauaaggcuaccguguacacagggagcgccgauaguucuccuaagcugggacgaguccaauuugcuacugacaccgauaaugacuucguggccaaucagaacacaaaauuuacuccagucggugugauccaggauggcgggaccgcacacagaaaugagccccaacaguggguuuugccguccuacagcggaaggaacacacacaaugugcaucucgccccugcuguagcgccaaccuuccccggcgaacagcuguuauuuuuccggucgacuaugccugguuguucuggguaucccaacauggaccuggauugccuccuuccacaggaguggguccaauacuuuuaucaggaagcagccccugcucaguccgacguggcccuguugcguuucguuaaucccgauacgggccgcgugcuauuugaguguaagcugcacaaaucaggauacgucacacaggcacauaccggccaacacgaccucgugauuccaccgaacggguauuucagauuugauaguuggguaaaccaguucuacacucuggccccuaugggaaaugguaccggcaggcggcgagcucuuuga

SEQ ID NO: 18645 - RNA, 1623 nt, Artificial Sequence
  derived and/or modified sequence opt3 from VP1__Norovirus__ALF12529
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucguguucucugccguaccuccaaauuuuccgacugagggccucucgcccucacagguuacgauguucccucauauuaucguggacguccgccaacuggagccagugcuuauaccccugccugaugugcgaaacaauuuuuaucacuacaaccagagcaaugacccaaccaucaaguugauugcaaugcucuauacaccccugcgugcuaacaacgccggggaugacgucuucacuguuaguugcagagugcugaccaggccguccccugauuuugacuucaucuuucucguacccccaacaguggaaucucggaccaaaccuuucagcguccccauuuuaacuguggaggaaaugacaaauucccgcuuuccaaucccccuggagaaacuuuucaccggaccuucaaguacguucguugugcagccacagaacgguagauguacuaccgauggcgucuugcuggggacaacucaacuaagcccggugaauauaugcaccuuuaggggagacguaacacauauugcgggcucucggaacuacaccaugaaucucgccucccagaacuggaacucauaugaucccacggaggaaaucccugcaccacuggguacucccgacuucguugggaagauucagggagugcuuacacagaccacucgcacagacggcagcacccgaggccacaaggcuacggucuacaccgggagugccgauuuuucuccuaagcugggaagagugcaauucgcuacagacacugauaaugacuuugaugccaaucagaacaccaaauucacaccagucggugugauccaggacggcaauacugcacauaggaacgagccccaacaguggguuuugccguccuacagcgggcggaauacccacaacgugcaccucgccccugcuguagcgccaacauuucccggagaacagcuguuauucuuucguucgaccaugccuggcuguucugguuaucccaauauggaucuggacugccuccuuccacaggaguggguccaauacuucuaucaggaagcagccccugcucaguccgauguggcccuguugcgcuuuguuaaccccgacacugggagagugcuauucgaguguaagcugcauaaaucaggcuacgucacgguggcacacacaggacagcaugaucucguaaucccaccgaacggcuauuuuagguucgacaguugggugaaucacuucuacacccuggccccuguugggaacggaacuggucggcgacgcgcucuuuga

SEQ ID NO: 18646 - RNA, 1623 nt, Artificial Sequence
  derived and/or modified sequence opt3 from VP1__Norovirus__ALF12530
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcagccacaacuacaccaugaaucucgcaucucagaacuggaacuccuaugaucccacggaggaaauuccugcuccacuggguacucccgacuucguagggaagauccagggaguucuuacacagaccacucgggccgacggcucaacacgcggccauaaggcuaccguguacacggggagcgccgauuuuaguccuaagcugggacgaguccaauucgcaaccgacacaaauaaugauuuugacgccaaccagaauacuaaauucaccccagugggugucauccaggauggcgagacagcucacagaaacgaaccccaacaguggguguugccgucuuacuccgggaggaauauucacaacguucaucucgcgccugcaguggccccaacuuuucccggagagcagcuguuauucuuucggagcaccaugccuggcuguucggguuaucccaauauggaacuggacugccucauaccacaggaguggguacaauacuucuaucaggaggcugccccugcacagucugaugucgcccuucugcguuuugugaaccccgacacagggcgcguuuuguucgaauguaagcuacacaaauccggcuacgugaccgucgcucauacuggacagcacgaucuggugaucccaccgaacggcuauuuuagauucgacucauggguaaaucaauucuacacgcucgccccuauggggaacggaacagguaggcggcgagcacuguga

SEQ ID NO: 18647 - RNA, 1623 nt, Artificial Sequence
  derived and/or modified sequence opt3 from VP1__Norovirus__ALF12531
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagaaacuuuucacgggacccucaagugcguucgugguucagccucagaacgguagauguacuaccgauggcguguugcuggggacaacucaacuaagcccagucaauauuugcaccuuuaggggagacgugacacauaucgccggcucucggaacuacaccaugaaucucgcaucccagaacuggaacucauaugauccgacggaggaaauucccgcuccucuggagacuccagacuucguagguaagauccaggggguucuuacacagaccacucgcacagacggaagcacccgaggccacaaggccacgguguacaccggcagugcugauuuuucucccaagcuggggagaguccaauucgccacagacacugauaaugacuuugauuccaaucagaacaccaaauucacaccugugggagucauccaggacgguggcacuacccauaggaaugaaccacaacaguggguguugcccagcuacucggggcgggauauucacaacguucaccucgcaccggccguggcuccuacauuuccaggagagcagcuguuauucuuucguucuaccaugcccggcuguuccgguuauccuaauauggaccuggauugccuccuuccccaggaauggguacaauacuucuaucaggaggcggcaccagcccagucagacgucgcucuguugcgcuuugugaacccugauacugggagaguucuauucgaguguaagcugcauaaaaguggcuacgugacggucgcccacacaggacagcaugaccucgugauacccccaaauggcuauuuuagguucgacagcuggguaaaccaauucuacacccuggcaccgauggggaacggaacuggucggcgacgcgugcuuuga

SEQ ID NO: 18648 - RNA, 1623 nt, Artificial Sequence
  derived and/or modified sequence opt3 from VP1__Norovirus__ALF12532
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgcuauugaccccuggauaagaaauaacuucguccaggcaccugguggcgaauuuacagugaguccaaggaaugcccccggggagauccuuuggagcgcuccucugggaccagauuugaaccccuacuuaucccaccuggcccggauguauaauggcuacgcggguggguucgaaguucaggugauucuagcaggaaacgccuuuacugcuggcaaaaucauuuucgccgcagucccuccaaauuuuccgacggagggccucucucccucacaggugaccauguucccucauaucauaguagacguucgccaacuggagccagugcuuaucccccugccugauguccgaaacaauuuuuaucacuacaaccagucgaaugacagcacaauuaaguugaucgcuaugcucuauacuccacugcgugccaacaacgcgggggaugacguguucaccgugaguugcagaguccugacaaggcccuccccggauuuugacuucauuuuucucguuccucccaccguggaaucucggacuaaaccauucagcguaccuaucuuaacaguggaggaaaugaccaauucccgcuuucccauaccacuggagaaacuuuucacgggacccucaagugccuucgucgugcagccucagaacgguagauguacuaccgauggcguuuugcuggggacaacucaacuaagcccagugaauauuugcaccuuuaggggagacgucacacauaucgcaggcucucggaacuacaccaugaaucucgcuucccagaacuggaacucauaugauccgacggaggaaauucccgccccucuggguacuccagacuucguggggaagauccagggaguacuuacacagaccacucgcacagacggcagcacccgaggccacaaggcuacgguuuacaccgggagugccgauuuuucucccaagcugggaagagugcaauucgcaacagacacugauaaugacuuugaugccaaucagaacaccaaauucacaccugucggugugauccaggacggcgggacuacccauaggaaugagccacaacagugggucuugcccuccuacagcggacggaacauucacaaugugcaccucgcuccggcgguugcaccuacauuuccaggcgaacagcuguuauucuuucguucgaccaugcccgguuguucuggguauccuaacauggaucuggacugccuccuuccccaggagugggugcaauacuucuaucaggaagccgcuccagcccaguccgauguagcacuguugcgcuuugucaauccugacacuggcagagugcuauucgaguguaagcugcauaaaucaggauacguuacgguggcccacacaggccagcaugaucucgucauacccccaaacggguauuuuagguucgacaguugggugaaccaauucuacacccuggcuccgaugggaaaugguacuggccggcgacgcgcccuuuga

SEQ ID NO: 18649 - RNA, 1623 nt, Artificial Sequence
  derived and/or modified sequence opt3 from VP1__Norovirus__ALF12533
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucacguucgcugccgugccuccaaauuuuccgaccgagggccucucucccucgcagguaacaauguucccucauauuaucguugacgugcgccaacuggagccaguccuuauaccccugccugaugugcgaaacaauuuuuaucacuacaaccagucaaaugacccaacuaucaaguugauugcaaugcucuauaccccucugcgugcuaacaacgccggggaugacguguucacagucagcugcagaguucugaccaggccgaguccugauuuugacuucaucuuucucgugcccccaacuguagaaucccggacaaaaccuuucucugugcccauuuuaaccgucgaggaaaugacgaauagccgcuuuccaaucccccuggagaaacuuuucacuggaccuuccucaaccuucgugguucagccacagaacgguagauguacaacugauggcguguugcuggggaccacacaacuaaguccggucaauauaugcaccuuuaggggagacgugacgcauauuacuggcagccacaacuacacaaugaaucucgcgucucagaacugguccucauaugaucccaccgaggaaaucccugccccacuggguacucccgacuucguagggaagauucagggaguucuuacacagaccacgcggaccgacggcagcacacgcggccauaaggcaacuguguuuaccgggagugcugauuucucuccuaagcugggacgaguccaauuugccacagacacugauaaugacuucguggcuaaccagaauaccaaauuuacaccagucggugugauccaggauggcgggaccgcccacagaaacgagccccaacaguggguuuugccguccuacagcggaaggaauauccacaacgugcaucucgcacccgccguagcuccaacuuuccccggcgaacagcuguuauuuuuccggucgacgaugccugguuguucuggguaccccaauauggaccuggauugccuccuuccacaggaguggguccaauauuuuuaccaggaagcggccccugcacaguccgacguggcucuguugcguuucguuaaccccgauacaggccgcgugcuauuugaguguaagcugcacaaaucaggauaugucaccguggcccauacuggccagcacgaccucguaauuccaccgaauggguacuucagauucgauaguugggugaaccaauuuuauacccuggcaccuaugggaaacgguacaggcaggcggcgagcccuuuga

SEQ ID NO: 18650 - RNA, 1623 nt, Artificial Sequence
  derived and/or modified sequence opt3 from VP1__Norovirus__ALF12534
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuccgggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauauccauaacgugcaccucgccccagcaguagcccccaccuuuccuggagagcagcuguuauucuuucguucuacuaugcccggcuguuccgguuauccaaauauggaucuggacugccuccuuccucaggaauggguccaauacuucuaucaggaggcugcgcccgcacagucagauguggcccuguugcgcuuuguuaacccagacacggggagagugcuauucgaguguaagcugcacaaaaguggcuacgucacaguggcucauaccggacagcacgaucucguaauuccgccuaacggcuauuuuagguucgacagcugggugaaucaauucuuuucccuggcccccauggggaacggaacuggucggcgacgcgcacuuuga

SEQ ID NO: 18651 - RNA, 1623 nt, Artificial Sequence
  derived and/or modified sequence opt3 from VP1__Norovirus__ALF12535
augaagauggccagcuccgacgcuaaccccucugugggcucagcagccaaucuggucccugagguuaacaaugaagugauggcgcucgagccaguagugggggcugccaucgcagccccggucgcuggacagcaaaacgugauugaucccuggauaagaaauaacuucguucaggcaccugguggcgaauuuaccgugaguccaaggaaugcccccggggagauccuuuggagcgcuccucugggaccagacuugaaccccuacuuaucccaccuggcccggauguauaauggcuacgcggguggguucgaaguccuagugauucucgcaggaaacgccuuuacagcuggcaaaaucauuuucgccgcaguaccuccaaauuuuccgacugagggccugucucccucgcagguuacgauguucccucauaucauaguggauguccgccagcuugagccagugcugauccccuugccugacgugcgaaacaauuuuuaucacuacaaccaaucaaaugauccaaccauuaagcucaucgcuaugcuguauacaccccugcgugccaacaacgcgggggacgaugucuucacuguuagcugcagagugcucaccaggccgaguccugacuuugauuucaucuuuuuaguacccccaacaguggaaucccggaccaaaccuuucucuguccccauucugacuguggaggaaaugacaaauagccgcuuuccaauaccccuugagaaguuguucaccggaccuuccucagccuucguugugcagccacagaacgguagauguacgacugacggcguccugcuagggaccacacagcucaguccggugaauauuugcacuuuuaggggagauguaacccauacaaccggcagccacaacuacacgaugaaucuggcaacucaaaacuggaacucuuaugaccccacagaggaaaucccugcuccacuugguacccccgauuucguugggaaaauucagggagugcugacucagacaaccaagacggacggcuccacccggggccauaaggccacagucuacacugggucagcugacuuugccccuaaauugggacgcgugcaguucgcaaccgauacagacaaugauuuugaggccaaucaaaacacuaaguucaccccagucggugugauccaggacggcgggacagcucaccgaaaugaaccccagcaauggguucucccgagcuacaguggaagaaacacccacaaugugcaucuggcgccugcaguagccccaacuuuucccggcgagcaguuacuguucuuuaggucuacgaugccugguuguuccggguaucccaacauggaucucgacugccuucugccacaggaauggguccaguacuucuaucaagaggcugccccugcacagagcgauguggccuugcuacgguuuguuaaucccgacacaggccgugugcuguucgaguguaaacuccacaagucgggauacgucaccguggcucauacuggcccacacgaucugguaaucccgccuaacggguauuuucgcuucgacucuugggugaaccaguucuacacccuugcccccaugggaaaugguacaggcagaaggcgggcacuguga

SEQ ID NO: 18652 - RNA, 1623 nt, Artificial Sequence
  derived and/or modified sequence opt3 from VP1__Norovirus__ALF12536
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccaucuuaacugucgaggaaaugacaaauagccgcuuuccaauaccccuggagaaacuuuucaccggaccuuccucagccuucgugguucagccacagaacgguagauguacgacugauggcguguugcuggggaccacacaacuaaguccggucaauauuugcacuuuuaggggagacgugacccauacaaccggcagccacaacuacacgaugaaucucgcaacucagaacuggucuuccuaugaucccacagaggaaaucccugcuccacuggguacccccgacuucguagggaagauucagggaguucuuacucagacaaccaagacggacggcucaacccggggccauaaggccacaguguacacugggagcgcugauuuugccccuaaacugggacgcguccaauucgcaaccgacacagauaaugacuuugaggccaaccagaauacuaaguucaccccagugggugucauccaggauggcaacacagcucaccgaaaugaaccccaacaguggguguugccgaguuacucugggagaaacacccacaauguucaucucgcgccugcaguggccccaacuuuucccggagagcagcuguuauucuuuagguccacgaugccuggcuguagcgguuaucccaacauggaccuggauugccuccuuccacaggaauggguacaauacuucuaucaggaggcugccccugcacagucggacgucgcccuguugcgguuugugaaucccgauacagggcguguucuauucgaguguaaacugcacaagucuggcuacgugaccgucgcucauacuggaccacacgaccucgugaucccgccuaacggcuauuuucgcuucgauuccuggguaaaccaguucuacacccuggcccccauggggaauggaacagguagaaggcgggcacuuuga

SEQ ID NO: 18653 - RNA, 1623 nt, Artificial Sequence
  derived and/or modified sequence opt3 from VP1__Norovirus__ALF12537
augaagauggccagcuccgacgcuaaccccucugauggcucaaccgcaaaucuggccccugaggugaacaaugaagucauggcgcucgagccaguugugggggcugccaucgcagccccgguagcuggacagaaaaacgugauugaccccuggauaagaaauaacuucguccaagcaccugguggcgaauuuacagugaguccaaggaaugcccccggggagauccuuuggagcgcuccucugggaccagauuugaaccccuacuuaucccaccuggcccggauguauaauggcuacgcggguggguucgaaguucaggugauucuagcaggaaacgccuuuacugcuggcaagaucauuuucgccgcagucccuccaaauuuuccgacggagggccucucucccucacaggugaccauguucccucauaucauaguagacguucgccagcuggagccagugcuuaucccccugccugauguccgaaacaauuuuuaucacuacaaccaaucgaaugacccaacaauuaaauugaucgcuaugcucuauacuccccugcgugccaacaacgcgggggaugacguguucaccgugagcugcagaguccugacaaggccgaguccugauuuugacuucauuuuucucguucccccaaccguggaaucccggacuaagccuuucucugcccccguauuaacaguggaggaaaugaccaauagccgcuuuccaaucccccuggagaaacuuuucacgggaccuuccucagcauucgucgugcagccacagaacgguagauguacuaccgauggcguuuugcuggggacaacucagcuaaguccggugaauauaugcaccuuuaggggagacgucacacauauuagcggcucucggaacuacaccaugaaucucgcuucccaaaacuggaacucauaugaucccacggaggaaaucccugccccacuggguacucccgacuucguggggaagauucagggaguacuuacacagaccacucgcacaaauggcagcacccgaggccacaaggcuacgguuuacaccgggagugccgacuuuucuccuaaacugggaagagugcaguucgcaacagauacugacaaugauuuugagaccaaccaaaauacaaaguucacuccagucggugugauccaggacggcuccaccacacccaggaacgaaccgcagcaaugggucuugccuagcuacucggggcggaauacccauaacgugcaccucgccccagcuguugcgcccacuuuuccuggagagcagcuguuauucuuucguucuacgaugcccggcuguuccgguuauccaaauauggaucuggacugccuccuuccucaggaaugggugcaguacuucuaucaagaggcagcccccgcucagucagauguagcccuguugcgcuuugucaacccagacacagggagagugcuauucgaguguaaacugcacaagaguggcuacguuaccguggcacauacuggacagagggaucucgucaucccgccuaacggcuauuuucgguucgacagcugggugaaucaguucuacucccuggcccccauggggaacggaaccggucgacgcagagcucuuuga

SEQ ID NO: 18654 - RNA, 1623 nt, Artificial Sequence
  derived and/or modified sequence opt3 from VP1__Norovirus__ALF12538
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucucugcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacgggaccuucaagugccuucgugguucagccacagaacgguagauguagcacugauggcguguugcuggggaccacacaacuaucuccggucaauauuugcacuuuuaggggagacgugacccauaucgcgggcucccacaacuacacaaugaaucucgccucacagaacuggagcaguuaugaucccaccgaggaaauuccugcaccacuggguacgcccgacuucguagggaagauccagggaguucuuacucagacaacccggucugacggcuccacucgcggccauaaggcuacaguguacaccgggagcgccgauuuuucgccuaagcugggacgaguccaauucgcuacggacaccgauaaugacuuugugucuaaccagaauacaaaauucacuccagucggugugauccaggauggcgacaccgcccacagaaacgagccccaacaguggguuuugccguccuacucagggaggaauauucacaacgugcaucucgccccugcaguagcuccaacauuucccggagaacagcuguuauucuuucggaguacuauaccuggcuguagcgguuaucccaauauggaucuggacugccuccuuccacaggaguggguccaauacuucuaucaggaagcggccccugcacaguccgauguggcucuguugcguuuuguuaaccccgacaccgggcgcgugcuauucgaguguaagcugcacaaaucuggcuacgucacaguggcccauaccggacagcacgaucucguaaucccaccgaauggcuauuuuagauucgacagcugggugaaccacuucuacacucuggcaccuauggggaacggaacggguaggcggcgaguucuuuga

SEQ ID NO: 18655 - RNA, 1623 nt, Artificial Sequence
  derived and/or modified sequence opt3 from VP1__Norovirus__ALF12539
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucgcaucauaguugacgugcgacaacuggagccaguccuuaucccccugccugaugugcguaacaauuuuuaucauuacaaccagucaaaugacccaacaauuaaguugaucgcaaugcucuauacuccccugagagcuaacaacgccggggaugacguguucaccgucagcugcaggguucugacacggccgaguccugauuuugacuucauuuuucucgugcccccaaccguagaaucccgcacuaaaccuuucucugugcccaucuuaacagucgaggaaaugaccaauagcagauuuccaauaccccuggagaaacuuuucacgggaccuuccucagcguucgugguucagccacagaacgguagguguaguacugauggcguguugcuggggaccacacaacuaagcccggucaauauuugcacuuuucggggagacgugacccacaucgccggcucucauaacuacacaaugaaucucgcaucccagaacuggucaagcuaugaucccaccgaggaaauuccugcuccacuggguacgcccgacuucguagggaagauccagggaguucuuacucagacaacccgcacugacggcaguacacgaggccacaaggccaccguguacacggggucugcugauuuuuccccuaagcugggaagaguccaauucgccaccgacacaaauaacgauuuugagagcaaucagaacacuaaauucgcaccagugggugucauccaggacggcgggaccgcccauaggaaugaaccccaacaguggguguugccgucguacucuggacggaacauucacaauguucaccucgcuccugcgguggcaccaacauuucccggcgagcagcuguuauucuuucguuccacuauaccugguuguucaggguaucccaacauggaucuggacugccuccuuccacaggaauggguacaauacuucuaucaggaggccgcuccugcccagagugaugucgcacuguugcgcuuugugaaucccgacaccggcagaguucuauucgaguguaagcugcauaaaagcggauacgugacagucgcccacaccggccagcaugaucucgugaucccaccgaacggguauuuuagguucgacuccuggguaaaccaauucuacacucuggcuccuaugggaaaugguacgggccggcgacgcgcccuuuga

SEQ ID NO: 18656 - RNA, 1623 nt, Artificial Sequence
  derived and/or modified sequence opt3 from VP1__Norovirus__ALF12541
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucaucgaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagugggaaacgcguuuacugcaggcaaaaucauuuucgccgcuguaccuccaaauuuuccgacggagggccucucucccucgcagguuaccauguucccucauaucauaguggacguccgccaacuggagccagugcuuaucccccugccugaugugcgaaacaauuuuuaucacuacaaccagucaagcgacaguacaauuaaguugaucgccaugcucuauacuccacugcgugcaaauaacgcuggggaugacgucuucaccguuuccugcagagugcugacaaggcccucuccggauuuugacuucauuuuucucguaccucccaccguggaaagccggacuaaaccauucuccgucccuguguuaacaguugaggaaaugaccaacucacgcuuucccaucccacuggagaaacuuuucacgggacccaguagcgccuucgugguccagccucagaaugguagauguacuaccgauggcguguugcuggggacaacucaacuaucuccaguaaacauaugcaccuuuaggggagacguuacacauauuuccggcucacacaauuacaccaugaaccucgcgagccagaauuggaacaguuaugauccgacggaggaaauccccgccccucuggguacuccagacuucguggggaagauucagggaguccuuacacagaccacucggacagacggcucuacccgcggccauaaggcaacgguguacaccggguccacagauuuuacucccaagcugggacgagcucaauucgccaccgacacagauaaugacuuugagacuaaccagaauaccaaauucacaccugucggugugauccaggauggcgggaccacucacagaaacgaaccacaacaguggguuuugcccagcuacucgggaaggaauacgcacaacgugcaucucgcuccggccguagcaccuacauuuccaggcgagcagcuguuauucuuucggucuaccaugcccgguuguuccggguauccuaauauggaccuggauugccuccuuccccaggaauggguccaauacuucuaucaggaggccgcuccagcgcagucagacguggcacuguugcguuuuguuaacccugauacuggccgcgugcuauucgaguguaagcugcacaaaaguggauacgucaccguggcccauacaggccagcacgaccucguaauucccccaaauggguauuuuagauucgauagcugggugaaccaauucuacacccuggcuccgaugggaaacgguacuggcaggcggcgagcccuuuga

SEQ ID NO: 18657 - RNA, 1623 nt, Artificial Sequence
  derived and/or modified sequence opt3 from VP1__Norovirus__ALF12542
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacugggugcccccgacuucgucgggaagauucagggaaugcuuacucagacaacccgcgcugacggcuccacucgaggccacaaggccacaguguacaccgggucagcagauuuugccccuaagcugggaagaguccaauucgagacggacaccgaucaugacuuugaagcuaaucagaacacaaaauucacuccaguggguguuauccaggauggcagcaccacacacaggaaugagccccaacaguggguguugccgaguuacucugggcggaacacucacaauguacaucucgcgccugcagucgccccaaccuuucccggagaacagcuguuauucuuucguuccacaaugccuggcuguagcgguuaucccaacauggaccuggauugccuccuuccacaggagugggugcaauacuucuaucaggaggcugccccugcacagucggacguugcccuguugcgcuuugugaaucccgauaccgggagaguccuauucgaauguaagcugcacaaaucuggcuacgugacuguagcucauacgggacagcacgaccucgugauuccaccgaacggcuauuuuagguucgauuccuggguuaaccaauucuacacacuggccccuauggggaauggagcaggucggcgacgcgcgcuuuga

SEQ ID NO: 18658 - RNA, 1623 nt, Artificial Sequence
  derived and/or modified sequence opt3 from VP1__Norovirus__ALF12543
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacugugauccgacggaggaaauccccgcuccucuggguacuccagacuucguugggaagauucagggaaugcuuacacagaccacucgcacagacggcucaacccgaggccacaaggccacgguguauaccgggagcgcugauuuugcccccaagcugggaagaguccaauucgagacagacacugaucaugacuuugaagcaaaucagaacaccaaauucacaccugugggugucauccaggauggcaguacuacccacaggaaugagccacaacaguggguguugcccucuuacuccgggcggaacacacacaauguucaucucgccccggcuguggcgccuaccuuuccaggagaacagcuguuauucuuucguagcacuaugcccggcugcucggguuacccuaacauggaccuggauugucuccuuccccaggaguggguacaauauuucuaccaggaggcagccccagcucagucugacgucgcccuguugcgcuuugugaauccugauacggggagaguucuauucgaaugcaagcugcacaaauccggcuaugugacagucgcacauaccggacagcacgaccucgugauucccccaaacggcuacuuuagguucgauucauggguaaaccaauucuauacucuggccccgauggggaauggaaccggucggcgacgcgcucuuuga

SEQ ID NO: 18659 - RNA, 1623 nt, Artificial Sequence
  derived and/or modified sequence opt3 from VP1__Norovirus__ALF12546
augaagauggccagcuccgacgcuaaccccucugagggcucaaccgcaagucuggugccugaagucaauaacgagguuauggcccucgaaccaguggcgggggcugccaucgcagccccgguagcuggacaggugaaugucauugaucccuggauaagaaacaauuucgugcaagcaccugguggcgaguuuacaguuagcccaaggaacgcccccggggaaauccuuugguccgcuccucugggaccagacuugaaucccuacuuaucucaccuggcccggauguauaacggcuacgcggguggguucgaggugcaggucauucuagcaggaaaugccuuuacugcuggcaaaaucauuuucgccgcagugccuccaaacuuuccgacggagggccucucgcccucacagguaaccauguucccucauaucauaguugaugugcgccagcuggaaccaguccuuaucccccugccugacgugcgaaauaacuuuuaucacuacaaucaaagcaacgagccaacaauuaaguugguggcuaugcucuauacuccccugcgugccaauaacgcgggggaugacgucuucaccguuaguugcagagugcugacaaggccguccccugauuuugacuucaucuuucucguacccccaaccguggaaucucggacuaaaccuuucagcguccccauuuuaacaguggaggagaugaccaacucccgcuuuccaaucccccuggaaaaacuuuucacgggaccuucaaguagcuucguugugcagccacagaaugguagauguacuaccgauggcgucuugcuggggacaacucagcuaucuccggugaacauaugcaccuuuaggggagacguaacacauauuuccggcucacggaaucacaccaugaaccucgccagccaaaauuggaacaguuacgaucccacggaggaaaucccugcaccacuggguacucccgacuucguugggaagauucagggagugcuuacacagaccacucgcucugauggcuccacacgaggccauaaggcuaccgucuauacggggagcgccgacuuuucgccuaagcugggaagaauccaguucgcuaccgacacagauaaugacuuugagacuaaccaaaauaccaaauucacaccagugggugucauccaggauggcgggacuacccacaggaacgaaccccagcaauggguguugccgacauacucuggacggaauacccacaacguucaucucgccccugcaguggccccaacuuuucccggcgagcagcuguuauucuuucguuccacgaugccugguuguucaggguaccccgacauggaucuggacugccuccuuccacaggaguggguacagcacuucuaucaagaagcugcgccugcacagagugaugucgcccuguugcgcuuugugaaucccgacacaggcagaguucuauucgaguguaagcugcauaaagcuggauacgugaccgucgcccacacuggccagcacgaucucgugauuccaccgaacggguauuuuagguucgacagcuggguaaaucaguucuuuacccuggcaccuaugggaaacgguacaggccggcgacgcgcccuuuga

SEQ ID NO: 18660 - RNA, 1623 nt, Artificial Sequence
  derived and/or modified sequence opt3 from VP1__Norovirus__ALF12547
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacccaaccauuaaguugaucgcuaugcucuauacaccccugcgugccaacaacgcgggggaugacguguucacugucagcugcagaguucugaccaggccgaguccugauuuugacuucauuuuucucgugcccccaacaguagaaucccggaccaaaccuuucucugugcccgucuuaacuguggaggaaaugacaaauagccgcuuuccaaucccccuggagaaacuuuucaccggaccuuccucagccuucguugugcagccacagaacgguagauguacgacugauggcgucuugcuggggaccacacaacuaaguccggugaauauaugcacuuuuaggggagacguaacccauauuacaggcagccggaacuacaccaugaaucucgcaucucagaacuggaauaacuaugaucccacggaggaaaucccugcuccacuggguacucccgacuucguugggaagauucagggaaugcuuacacagaccacucgcacagacggcuccacccgaggccacaaggccacgguguacaccgggucagcugauuuugccccuaagcugggaagaguccaauucgagacagacacugaucaugacuuugaagcaaaucagaacaccaaauucacaccagugggugucauccaggauggcagcacuacccacaggaaugagccccaacaguggguguugccgaguuacucugggcgguccgcccacaacguucaucucgcuccugcgguggcaccaacauuucccggagaacagcuguuauucuuucguagcaccaugccuggcuguucggguuaucccaauauggaccuggauugccuccuuccacaggaguggguacaauacuucuaucaggaggccgcuccugcccagucugacgucgcacuguugcgcuuugugaaccccgauacugggagaguucuauucgaauguaagcugcacaaauccggcuacgugacggucgcccauacaggacagcacgaccucgugaucccaccgaauggcuauuuuagguucgauucauggguaaaccaauucuacacccuggcuccuauggggaacggaacuggucggcgacgcgcccuuuga

SEQ ID NO: 18661 - RNA, 1623 nt, Artificial Sequence
  derived and/or modified sequence opt3 from VP1__Norovirus__ALF12560
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucagagcaacgacccaacaauuaaguugaucgcaaugcucuauacuccccugcgugcuaauagugccggggaugacguguucaccgucuccugcagaguucugacaaggccgucuccugauuuugacuucauuuuucucgugcccccaaccguagaaagccggacuaaaccuuucuccgugcccaucuuaacagucgaggaaaugaccaacucacgcuuuccaauaccccuggagaaacuuuucacgggaccuaguagcgcguucgugguucagccacagaacgguagauguacuaccgauggcguguugcuggggacaacucaacuaucuccggucaauauuugcuccuuuaggggagacgugacccauaucgccggcucacggaacuacacaaugaaucucgcaagccagaacuggaauaguuaugaucccaccgaggaaauuccugcuccacuggguacgcccgacuucguagggaagauccagggaguucuuacucagacaacccgcacugacggcucuacacgaggccacagagccaccguguacacgggguccgcugauuuuagcccuaagcugggaaggguccaauucgccaccgacacagauaacgacuuuguggcaaaucagaacacuaaguucaccccagucggugugauccaggauggcgacacagcccaucggaaugagccccaacaguggguuuugccgucguacucugggcguaacauucacaaugugcaccucgcuccugcgguagcaccaacuuuucccggagaacagcuguuauucuuucgcuccaccaugccuggcuguucagguuaucccaacauggaucuggacugccuccuuccacaggaguggguccaacauuucuaccaggaagccgcuccugcccagagugauguggcacuguugagauuuguuaaucccgacacagggagggugcuauucgaguguaaacugcacaagagcggcuaugucaccguggcccauacuggacagcacgaucucguaauaccaccgaacggcuacuuucgguucgacuccugggugaaucaauucuauacgcuggcuccuauggggaacggaacaggucgacgcagagcccuuuga

SEQ ID NO: 18662 - RNA, 1623 nt, Artificial Sequence
  derived and/or modified sequence opt3 from VP1__Norovirus__ALF12562
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcacuccucugggaccagauuugaaccccuacuuaucccaccuggcccggauguauaauggcuacgcugguggguucgaagugcaggucauucuagccggaaacgcguuuacggcaggcaaaaucauuuucgccgcugugccuccaaauuuuccgaccgagggccucucucccucgcagguaacaauguucccucauaucauaguugacgugcgccaacuggagccaguccuuaucccccugccugaugugcgaaacaauuuuuaucacuacaaccagucaaaugacccaacuauuaaguugaucgccaugcucuauacaccccugcgugcaaacaacgcuggggaugacguguucaccgucagcugcagaguucugaccaggccgaguccugauuuugacuucauuuuucucgugcccccaacuguagaaucccggacaaaaccuuucucugugcccgucuuaaccguggaggaaaugacgaauagccgcuuuccaaucccccuggagaaacuuuucacuggaccuuccucagccuucguugugcagccacagaacgguagauguaccacagauggcgucuugcuggggacuacccaacuaaguccggugaauauaugcacauuuaggggagacguaacccauauuagcggcucucggaacuacacgaugaaucucgcgucccagaacuggaacucauaugaucccacugaggaaaucccugccccacuggguacacccgacuucguugggaagauucagggagugcuuacccagacuacacgcaccgacggcagcacgcgaggccacaaggcaaccgucuacacagggagugcugauuuuucuccuaagcugggaagagugcaauucgccacugacaccgauaaugacuuugagacaaaucagaacacuaaauucaccccagucggugugauccaggauggcuccacaacccauaggaaugaaccccaacaguggguuuugccgagcuacucggggcggaacacucacaaugugcaccucgcuccugccguagcaccaacguuucccggagagcagcuguuauucuuucguucuacaaugccuggcuguuccgguuaucccaacauggaccuggauugccuccuuccacaggaauggguccaauacuucuaucaggaggccgcuccugcgcagucagacguggcacuguugcgcuuuguuaaucccgauaccgggagagugcuauucgaguguaagcugcauaaaaguggcuacgucacuguggcccacaccggacagcaugaccucguaaucccaccgaacggcuauuuuagguucgauagcugggugaaccaauucuacacacuggcuccuauggggaauggaaccggucggcgacgcgcccuuuga

SEQ ID NO: 18663 - RNA, 1623 nt, Artificial Sequence
  derived and/or modified sequence opt3 from VP1__Norovirus__ALF12564
augaagauggccagcuccgacgcuaacucuucagauggcagugcagccaaucuggugcccgaggucaacaaugaaguuauggcgcucgagccugugguaggggcugccaucgcagccccaguggcuggacagcaaaacgucauugacccguggauaagaaauaacuucgugcaggcacccgguggcgaauuuaccguuagcccuaggaaugccccaggggagauccuuugguccgcuccccugggaccugauuugaacccauacuuaucucaccuggcccggauguauaauggcuacgcggguggguucgaagugcaggucauucuagcaggaaacgccuuuacagcuggcaaaaucauuuucgccgcagugcccccuaauuuuccaacugagggccucucgccgucacagguaacgauguucccccauaucauaguugacgugcgccaacuggagccuguccuuaucccacugcccgaugugcgaaacaauuuuuaucacuacaaccagagcaaugacccuaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccuaucuuaacugucgaggaaaugacaaauucccgcuuucccauaccacuggagaaacuuuucaccggacccucaagugccuucgugguucagccucagaacgguagauguacgacugauggcguguugcuggggaccacacaacuaagcccagucaauauuugcacuuuuaggggagacgugacccauaucacaggcucucggaacuacaccaugaaucucgcaacgcagaacuggaacuccuaugauccgacugaggaaauucccgcuccucuggguacaccagacuucguagggaagauccagggaguucuuacccagacuacaaagaccgacggcucaacgcgcggccacaaggccaccguguacacagggagcgcugauuuugcccccaaacugggacgaguccaauucgcaacugacaccgauaaugacuuugaggccaaucagaacacaaaguucacuccugugggugucauccaggauggcgggaccacacauagaaaugaaccacaacaguggguguugcccaguuacucuggaaggaacacccacaauguucaccucgcuccggcgguggcaccuacuuuuccaggcgagcagcuguuauucuuucgguccacgaugcccgguuguagcggguauccuaacauggaccuggauugccuccuuccccaggaauggguacaauacuucuaucaggaggccgcuccagcccagucggacgucgcacuguugcguuuugugaauccugauacaggccgcguucuauucgaguguaaacugcauaagucuggauacgugaccgucgcccacacuggcccccaugaccucgugauuccaccgaacggguauuuuagauucgauuccuggguaaaccaguucuacacccuggcuccuaugggaaaugguacaggcaggcggcgagccaccuga

SEQ ID NO: 18664 - RNA, 1623 nt, Artificial Sequence
  derived and/or modified sequence opt3 from VP1__Norovirus__ALF12566
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagagauaauuucgugcaggcaccugguggcgaauuuaccguuaguccaaggaacgcccccggggagauccuuuggagcgcuccucugggaccagacuugaaucccuacuuaucccaccuggcccggauguauaacggcuacgcggguggguucgaagugcaggucauucuagcaggaaaugccuuuacagcuggcaaagugaucuucgccgcaguaccuccaaacuuuccgacugagggccucucucccucgcagguuacgauguucccucauaugauuguggauguccgccaacuggagccagugcuuaucccccugccugacgugcgaaauaacuuuuaucacuacaaucagucaaacgauccaaccuugaagcucauagcuaugcuguauacaccccugcgugccaauaacgcgggggacgaugucuucacuguuagcugcagagugcucaccaggccgaguccugacuuugauuucaucuuuuuaguacccccaacaguggaaucccggaccaaaccuuucucuguccccgugcugacuguugaggaaaugacaaacagccgcuuuccaauuccccuugagaaguuguucaccggaccuuccucagccuucgugguccagccacagaaugguagauguacgacugacggcgugcugcuagggaccacacaacucaguccgguaaacaucugcacuuuuaggggagauguuacccauauuacaggcagccggaauuacaccaugaaccuggcaucucagaauuggaacaauuaugaccccacggaggaaaucccugcuccacuuggugcccccgacuucguggggaaaauacagggaaugcugacucagacaacccgcacugauggcuccacacgaggccacaaggcuaccgucuacacggggucagccgacuuugcaccuaaguugggaagagugcaauucgagaccgauacagaccaugauuuugaagccaaccagaauacuaaauucaccccagucggugugauucaggacggcagcacaacucacaggaacgagccccaacaguggguucucccgaguuacucugggcggaauacccacaacgugcaucuggcuccugcgguagcaccaacauuucccggagaacaguuacuguucuuucguuccaccaugccuggcuguagcgguuaucccaauauggaucucgacugccuucugccacaggaguggguccaauacuucuaucaggaggccgcuccugcccagucggauguggcauugcuacgcuuuguuaaccccgacacugggagagugcuguucgaauguaagcuccacaaaucuggcuacgucacgguggcccauacaggacagcacgaucugguaaucccaccgaauggcuauuuuagguucgacuccugggugaaccaauucuacacccuugcuccuauggggaacggaacuggucggcgacgcauuguuuga

SEQ ID NO: 18665 - RNA, 1623 nt, Artificial Sequence
  derived and/or modified sequence opt3 from VP1__Norovirus__ALF12569
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaugacguguucacugucaguugcagaguucugaccaggcccuccccggauuuugacuucauuuuucucgugccucccacaguagaaucucggaccaaaccauucagcgugccugucuuaacuguggaggaaaugacaaauucccgcuuucccaucccacuggagaaacuuuucaccggacccucaagugccuucguugugcagccucagaacgguagauguacgacugauggcgucuugcuggggaccacacaacuaagcccagugaauauaugcacuuuuaggggagacguaacccauauuacaggcucucggaacuacaccaugaaucucgcaucccagaacuggaauaacuaugauccgacggaggaaauccccgcuccucuggguacuccagacuucguugggaagauucagggaaugcuuacacagaccacucgcacagacggcucaacccgaggccacaaggccacgguguacaccgggagcgcugauuuugcccccaagcugggaagaguccaauucgagacagacacugaucaugacuuugaagcaaaucagaacaccaaauucacaccugugggugucauccaggauggcaguacuacccacaggaaugagccacaacaguggguguugcccucuuacuccgggcggaacacacacaauguucaucucgccccggcuguggcgccuaccuuuccaggagaacagcugcccuucuuucguagcacuaugccuggcuguucggguuaucccaacauggacuuagauugccugcucccacaggaguggguacaauacuucuaucaggaggcagccccugcucagucugacgucgcccuucugcgcuuugugaaucccgauacggggagaguuuuguucgaauguaagcuacacaaauccggcuacgugacagucgcacauaccggacagcacgaccuggugaucccaccguauggcuacuuuagguucgauucauggguaaaccaauucuauacucucgccccuauggggaacggaaccggucggcgacgcgcucuguga

SEQ ID NO: 18666 - RNA, 1623 nt, Artificial Sequence; identical to SEQ ID NO: 18640
  derived and/or modified sequence opt3 from VP1__Norovirus__ALQ28762

SEQ ID NO: 18667 - RNA, 1632 nt, Artificial Sequence
  derived and/or modified sequence opt3 from VP1__Norovirus__ALS03883
augaagauggccagcaacgacgcugcacccuccaaugauggcgccgcggggcuggugccugagaucaacaaugaaaccauggcucucgagccagucgccggaggugcaauugccgcuccgcuuacaggccagacuaacuucauagaccccuggaucagagggaauuacguucaagcaccuaacggagaauuuacggugucuccaaggaacucacccggcgagauucuguugaauuuagaacuggguccugagcuaaauccauuccucagucaccugagccggauguauaacggguacgccggaggcaucgauguacaggugauuauggcuggcaaugccuuuaccgcggggaaaaucauauucgcagccauucccccucauuuuccagucgagaaccuuuccccgccccagaucacaauguucccucacaucauuguggacguucgcacucuggaaccaaucaauauacccgugccugauguccgaaacaacuuuuuccauuauaaucagaacaaugagucucguaugagauugguggcuaugcucuacaccccacugaggucgaacggaucagccgaagacguauuuacaguuagcugccgggugcugaccaagcccagugcagauuucgaguuuaauuaucucgucccgccuacuguggagucccgcacaaaacccuucaccauuccaaucuuaacgauuggugaaaugacuaacucuagauuuccugugcccaucgacaugcugcacaccagcccaacagagaauaucgucguucaaccccagaacgggagguguacuauugauggcgaacuuuugggaaccacacagcugauaaccuccaauaucugcucauuccggggcaguauuagcggucaugaggggaacgacgaucagcaccuauggcacuucaauaucacgaacccuaauggaacuccauuugacccgacagaagaugugcccgcuccucucggcaccccagacuuccgcggccaacuguacgggguaauaucucagcgagacagagagggaacucccuccgagaacaaucagaaggccaacaggucacaucagggugugauuagcacaaucaguccuaaauuugucccaaaacuuggcucugugaugaucgggaccuggacgaccgaugacauuaagaaucaacccuccaaguucacaccgaucggacugaacgaugacgauaacuuuaagcagugggaauugccuaauuauagcggcgcgcucacucugaacauggguuuagccccaucgguuuuccccaccuacccuggggagcagauucuguuuuuccggucuuaccucccccuuaaaggcggauauggcuccccauuuauagacugucuggugccucaagaaugggucgcacacuucuaccaggagucagcucccgcccagacagauguggcuuugauccguuauguaaauccagaaacugggcgcguucuauuugaggccaagcugcauagacagggauucauuaccguggcaaaaaguggugacagcccgaucaacgucccugccaauggcuacuuuagguucgauuccugggugaaccaauucuauucucucgcucccauggggacaggaaauggccggcgacgcauccaguga

SEQ ID NO: 18668 - RNA, 1617 nt, Artificial Sequence
  derived and/or modified sequence opt3 from VP1__Norovirus__ALT06546
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauaauaaccagccaaacucccguaugagacugguugcaaugcuuuacacacccuugaggucuaaugggucgggagacgauguguucaccgucucaugccgggugcugacucgcccgacaccugacuuugaguucaccuaucuagugcccccaagcgucgaaaguaagacgaaaccuuuuucccuccccauucugacucuuucugagcugaccaacagcagauucccaguucccaucgauuccuuguuuacagcucaaaauaacgugcuccagguacagugucagaaugguaggugcacucuggacggcgaguuacaagggaccacacagcugcucccuucaggaauuugugccuuccggggccgcgugaccgcggaaacggaucaucgagacaaguggcacaugcagcuucagaaccugaaugguacuacauacgauccaaccgacgacgucccggcccccuuggggacuccugauuucaaaggagugguuuuuggcauggcaagucaaagaaacgugggcaaugacgcuccagggagcacaagggcccaugaggcugucaucucuaccuauucaccccaguucgugccuaagcuaggauccguaaacuuucggagcaaugauaacgacuuccagcugcaaccaacgaaguuuacccccguugguauaaaugaugacggcgaucacccguuccgucagugggaacucccugacuacagugggccacugacacuuaacaugaaucuggcacccccuguggcccccaacuuuccaggagagcagcucuuguucuuucgcucuuucgucccuugcuccggcgguuacaaccaggggauuguggauugucugaucccccaagaauggauucagcacuuuuaucaggagagcgccccaucgcagucugacgucgcuuuaaucagauacgugaauccggauacuggcaggacccuguucgaggcgaaacuacaucgguccggauauaucacaguugcacacucaggcgacuacccucucgugguacccgccaacggguauuuucgauucgacaguugggucaaucaauucuacagccuggcuccaaugggaacugguaacggccgcagaagggcccaguga

SEQ ID NO: 18669 - RNA, 1647 nt, Artificial Sequence
  derived and/or modified sequence opt3 from VP1__Norovirus__BAG30939
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcaggcaaugccuuuacggcuggcaaaauuaucuucgccgcaauacccccuaacuuuccaaucgacaaucuuagugcucggcagauuaccaugugcccgcauguuaucguggauguccgccaacuggagcccgugaacuugccuaugccagacguacgaaauaacuucuuucacuauaaccaggggagcgauucccgucucagacugauugccaugcuguacacaccccucagggcgaauaacucuggagacgauguuuucacugugucgugucgggucuuaacccgcccuucaccagacuuuagcuucaauuuucuggugcccccgacaguggaaaguaagaccaaaccuuucacucuucccaucuugacaauauccgagaugucuaacagcagauuuccagucccuauugauucccugcauaccucacccacggaaaauaucguugugcagugccagaacgguaggguaacucuagacggcgagcucauggggaccacacaacugcuuccaagucagauuugugccuucaugggagugcugacucggagcaccucucgcgcauccgaucaggcugacacagccacgccccgauuguucaauuauuacuggcacauccagcucgacaacccuaauggcaccccauaugauccggcugaggacauccccgguccucuggggacuccagauuuuagaggaaaggucuucggcguggccucacaaaggaaccccgacagcacaacccgggcacaugaagccaaaguugauacuacagcuggccguuuuaccccuaaguuagggagucuggagauuucuacggaauccgacgauuuccaccagaaucagccaacccgcuuuacacccgugggaauaggugucgacaacgaggcggauuuccaacaguggagccucccggacuacucgggccaguuuacucacaauaugaaccuugcgccugccguggcuccaaauuuccccggggaacagcuguuguuuuucagaucucaacuaccuuccucaggaggcaggaguaacgguauccuggauugccucguaccccaggaguggguucagcauuuuuaccaggagagcgccccaucccaaacccagguggcacugguccgguaugugaacccugacacagggcgaguccuuuucgaagccaagcugcacaaauugggcuuuaugacuauugcuaagaauggagacucucccaucaccgugccaccgaacggcuacuuccgcuucgagagcuggguuaauccuuuuuauacacucgcccccauggggaccggaaacgguagaaggcggauacaguga

SEQ ID NO: 18670 - RNA, 1623 nt, Artificial Sequence; identical to SEQ ID NO: 18112
  derived and/or modified sequence opt3 from VP1__Norovirus__BAG70428

SEQ ID NO: 18671 - RNA, 1623 nt, Artificial Sequence; identical to SEQ ID NO: 18112
  derived and/or modified sequence opt3 from VP1__Norovirus__BAG70431

SEQ ID NO: 18672 - RNA, 1623 nt, Artificial Sequence
  derived and/or modified sequence opt3 from VP1__Norovirus__BAG70434
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaaugcacacaacguucaucuggccccugcuguggcgccaaccuuucccggcgagcaguuacuguucuuuaggagcacuaugccugguuguucgggguaucccaauauggaucucgacugccuucugccacaggaguggguacagcacuucuaccaagaagcagccccugcucagucugaugucgccuugcuacgguuugugaaccccgacacgggccguguucuguucgaguguaaacuccauaaguccggauaugugacagucgcacacaccggccagcacgaucuggugauuccaccgaacggguacuuucgcuucgacucauggguaaaucaguucuauacucuugccccuaugggaaacgguaccggcagaaggcgggcucuguga

SEQ ID NO: 18673 - RNA, 1623 nt, Artificial Sequence
  derived and/or modified sequence opt3 from VP1__Norovirus__BAG70437
augaagauggccagcaacgacgcuaaucccuccgauggcucuaccgcaaaccuggugccugaggucaauaacgaaguuauggcccucgagccagugguaggggcggcuaucgccgcaccgguggccggacagacaaaugucauugaccccuggauaagaaacaauuucgugcaagcuccugguggcgaauuuacuguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacggccggcaaaaucauuuucgcuaaggugccuccaaacuuuccgaccgagggccucucccccucucagguaacaauguucccucauaucauaguugacgugcgccagcuggagccaguccuuaucccccugccugaugugcgaaauaacuuuuaucacuacaaucaaucgaacgacucaacuauuaaauugaucgccaugcucuauaccccacugcgugcaaacaaugcuggggaagauguguucacagucagcugcagaguucugaccaggcccaguccggacuuugauuucauuuuucucgugccucccacuguagagucccggacaaagccauucaccgugccuaucuuaacggucgaagagaugacuaacucucgcuuucccauaccacuggagaaacuuuucaccggacccagcggugccuucgugguucagccucagaauggcagauguacaacugacgggguguugcugggaaccacacagcuauccccagucaacauuugcaccuuuaggggcgaugugacgcauaucgcggguucacggaauuacacuaugaaccucgccagucugaauuggaacaauuaugacccgacagaagagauucccgcaccucuugggaccccagauuucguaggaaagauccaaggcguucugacucagacaaccaagggcgacgggagcacgcgcggacacaaagcuaccguguacacagguucugcccccuuuacuccuaaguugggcuccguccaguucucaaccgacacagaaaacgauuuugagacucaucagaauaccaaauucacaccagugggggucauccaagacggaagcaccacucaccgaaacgaaccccagcagugggugcucccgaguuacucuggcagaaauguucacaacgugcaucuggcuccugccguagcaccaacguuucccggugagcaauuacuguucuuuagguccacaaugccuggguguagcggcuaucccaauauggaucucgacugccuucugccacaggaguggguccagcacuucuaccaggaagccgcuccugcgcaaucggauguggcauugcuacgguuuguuaaccccgacaccggacgugugcuguucgaguguaagcuccauaaaucuggcuaugucacuguggcccacaccgggcagcacgaucugguaauuccaccgaacggauacuuucgcuucgacuccugggugaaucaguucuauacacuugcuccuauggguaacggcaccgggagaaggcgggcccuguga

SEQ ID NO: 18674 - RNA, 1623 nt, Artificial Sequence
  derived and/or modified sequence opt3 from VP1__Norovirus__BAG70440
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugacgaacucucgcuuucccauaccacuggagaaacuuuucacuggacccagcuccgcguucgugguucagccucagaaugguagauguaccacagauggcguguugcuggggacuacccaacuaucaccagucaacauuugcacauuuaggggagacgugacccauaucgccggcagucggaauuacacgaugaaccucgcaagccugaauuggaacaauuaugauccgacugaggaaauucccgcuccucuugguacaccagacuucguagggaagauccagggaguucugacccagacuacaaagggcgacggcucuacccgcgggcacaaggccacgguguacaccggauccgcucccuuuacaccuaaauuggguucaguccaguucagcacugauaccgagaacgacuuugaaacacaucaaaauacuaaguucaccccagugggcgucauccaggaugggggaacaacccaccgaaacgagccccagcaaugggugcucccgaguuacucuggcagaaauguucacaacgugcaucuggccccugcaguagccccaacuuuucccggugaacaguuacuguucuuuagguccacgaugccuggguguagcggcuaucccaauauggaccucgauugccuucugccacaggaguggguccagcacuucuaccaagaggcugcgccugcacagucggacguggccuugcuacgguuuguuaaccccgauacaggacgugugcuguucgaauguaaacuccauaagucuggcuaugucaccguggcuuacacugggcagcacgaccugguaauuccaccgaacggauauuuucgcuucgauuccugggugaaucaguucuacacccuugccccuauggguaacggcacagggagaaggcgggcacuguga

SEQ ID NO: 18675 - RNA, 1623 nt, Artificial Sequence
  derived and/or modified sequence opt3 from VP1__Norovirus__BAG70446
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccgggacccaggaguacacgaugaaccucgcaucucagaauuggaacaauuaugaucccacugaagagauuccugcuccacugggcacacccgacuucguagguaagauccaggggguucuuacccaaacuacacggcgcgacggauccacccgaggccacaaggccacggugucaaccggcagcguccauuuuacaccuaagcuggggagaauccaguucaguacugauaccucuaacgacuuugaaacaggacagaauacuagguucaccccagugggugucgugcaagauggcuccacaacccaccagaacgagccccagcaguggguuuugccgaauuacagcgggcgggacucgcacaacgugcaucucgcuccugccguagcaccaucuuuucccggagaacaacuguuauucuuucguuccacuaugccuggcuguucagguuaccccaauaugaaccuggauugccuccuuccacaggaguggguccagcacuucuaucaggaggccgcuccugcgcaaagugacguggcacuguugcgcuuuguuaaucccgauacggggagagugcuauucgaauguaaacugcauaagagcggcuacgucacaguggcccacaccggacagcacgaccucguaauuccaccgaacggcuauuuuagguucgauuccugggugaaccaguucuacacucuggcuccuauggggaauggaaccggucggcgacgcgcccuuuga

SEQ ID NO: 18676 - RNA, 1623 nt, Artificial Sequence
  derived and/or modified sequence opt3 from VP1__Norovirus__BAG70449
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacuccuacgcgggcgguuucgaagugcaggucauucuagcagggaaugccuuuacagcuggaaaaaucauuuucgccgcagugccuccaaacuuuccgacugagggccucucucccucgcagguaacgauguucccucauaucauaguugacgugcgccaacuggagccaguccuuaucccccugccugaugugcgaaauaacuuuuaucacuacaaucagucaaacgacccaaccauuaaguugaucgcuaugcucuauacaccccugcgugccaacaaugcgggcgaagauguguucacugucagcugcagaguucugaccaggccgaguccugacuuugauuucauuuuucucgugcccccaacaguagagucccggaccaaaccuuucacugugcccaucuuaacagucgaagagaugaccaacucucgcuuuccaauaccccuggagaaacuuuucacggggccuagcggagccuucgugguucagccacagaaugguagauguacuaccgacggcguguugcuggggacaacucaacuauccccggucaacauuugcaccuuuaggggagaugugacacauaucgcaggcucacggaauuacaccaugaaccucgcuagucugaauuggaacaauuaugaccccacggaagagauuccugccccacuugguacucccgauuucguagggaagauccagggaguucugacacagaccacuaagggcgacggcagcacacgcgggcacaaggcuaccguguacacgggaucugccccuuuuaccccaaaauuggguuccguccaguucucaacagacacugaaaacgauuuugagacccaucaaaauacaaaguucacucccgugggcgucauccaggacgggagcaccacacaccgaaacgaaccgcagcaaugggugcucccuaguuacucuggaagaaauguucacaacgugcaucuggcaccagccguagcucccaccuuuccuggcgagcaguuacuguucuuuagguccacuaugcccgguuguagcggguauccaaauauggaucucgacugccuucugccucaggaguggguccagcacuucuaccaagaagcggcacccgcccagucggauguggcuuugcuacgguuuguuaacccagacacgggccgugugcuguucgaguguaaacuccauaagucuggauaugucacaguggcccacaccggccagcacgaucugguaauuccgccuaacggguacuuucgcuucgacuccugggugaaucaguucuauacucuugcacccaugggaaacgguaccggcagaaggcgggcccuguga

SEQ ID NO: 18677 - RNA, 1623 nt, Artificial Sequence
  derived and/or modified sequence opt3 from VP1__Norovirus__BAG70452
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaauugaacgacucgacaauuaagcucaucgcuaugcuguauacuccacugcgugccaacaaugcgggggaagauguguucaccgucucaugcagaguucucacaaggcccagcccggacuuugauuucauuuuucuggugccucccaccguagagagucggacuaaaccauucacagugccuauccugaccgucgaagagaugacgaacucccgcuuucccauaccacuugagaaguuguucacuggacccucuggugccuucgugguucagccucagaauggcagauguaccacagacggggugcugcuaggaacuacccagcucagcccagucaacauuugcacauuuaggggcgaugugacccauaucgcagguucccggaauuacacgaugaaccuggcuucacuuaauuggaacaauuaugacccgacugaagagauucccgccccucuggggacaccagauuucguaggaaaaauccaaggcguuuugacccagacuacaaagggcgacgggaguacccgcggacacaaggcuacgguguacaccgguagcgcccccuuuacaccuaaacucggcucuguccaguucuccacugacaccgaaaacgauuuugagacacaucagaauacuaaguucaccccagugggggucauccaagacggaucaacaacccaccgaaacgaaccccagcagugggugcugccgagcuacaguggcagaaauguucacaacgugcauuuagccccugcaguagcuccaacuuuucccggugagcaauuacucuucuuuaggucuacgaugccuggguguuccggcuaucccaauauggaucuugacugccuguugccacaggaguggguccagcacuucuaccaggaagcggccccugcacaaagcgauguggcucuacugcgguuuguuaaccccgacacaggacguguccucuucgaguguaaacugcauaagucgggcuaugugaccguggcccacacugggcagcacgaucuuguaauuccaccgaacggauacuuucgcuucgacucuugggugaaucaguucuauacccuggcaccuauggguaacggcacagggagaaggcgggccuuguga

SEQ ID NO: 18678 - RNA, 1623 nt, Artificial Sequence; identical to SEQ ID NO: 17982
  derived and/or modified sequence opt3 from VP1__Norovirus__BAG70458

SEQ ID NO: 18679 - RNA, 1623 nt, Artificial Sequence; identical to SEQ ID NO: 17660
  derived and/or modified sequence opt3 from VP1__Norovirus__BAG70461

SEQ ID NO: 18680 - RNA, 1623 nt, Artificial Sequence; identical to SEQ ID NO: 17660
  derived and/or modified sequence opt3 from VP1__Norovirus__BAG70464

SEQ ID NO: 18681 - RNA, 1623 nt, Artificial Sequence; identical to SEQ ID NO: 17660
  derived and/or modified sequence opt3 from VP1__Norovirus__BAG70467

SEQ ID NO: 18682 - RNA, 1623 nt, Artificial Sequence; identical to SEQ ID NO: 18112
  derived and/or modified sequence opt3 from VP1__Norovirus__BAG70470

SEQ ID NO: 18683 - RNA, 1623 nt, Artificial Sequence; identical to SEQ ID NO: 18112
  derived and/or modified sequence opt3 from VP1__Norovirus__BAG70473

SEQ ID NO: 18684 - RNA, 1623 nt, Artificial Sequence
  derived and/or modified sequence opt3 from VP1__Norovirus__BAG70476
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaggaacuucccgccccucuggggacuccagauuucguaggaaaaauucagggcguuuugacacagaccacuaagggcgacgggagcacacgcggacacaaggcuaccguguacacggguucugcccccuuuaccccuaaacucggcuccguccaguucucaacagacacugaaaacgauuuugagacccaucaaaauacaaaguucacuccagugggggucauccaggacggaagcaccacacaccgaaacgaaccccagcaaugggugcugccgaguuacucuggcagaaauguucacaacgugcauuuagccccugcaguagcuccaaccuuucccggugagcagcuucucuucuuuagguccacuaugccuggguguagcggcuaucccaauauggaucuugacugccuguugccacaggaguggguccagcacuucuaccaagaagcggccccugcacagucggauguggcucuacugcgguuuguuaaccccgacacgggacguguccucuucgaguguaaacugcauaagucuggcuaugugacaguggcccacaccgggcagcacgaucuuguaaucccaccgaacggauacuuucgcuucgacuccugggugaaucaguucuauacucuggcaccuauggguaacggcaccgggagaaggcgggccuuguga

SEQ ID NO: 18685 - RNA, 1623 nt, Artificial Sequence
  derived and/or modified sequence opt3 from VP1__Norovirus__BAG70482
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugacggccucucccccucucagguaacgauguucccucauaucauaguugaugugcgccaacuggagccaguccuuaucccccugccugacgugcgaaauaacuuuuaucacuacaaucagucgaacgauucaaccauuaaguugaucgcuaugcucuauacaccacugcgugccaacaaugcgggggaggacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccaguucagcacagauacugagaacgacuuugaaacccaucaaaauacaaaguucacuccagugggcgucauccaggaugggggaaccacacaccgaaacgagccccagcaaugggugcucccgaguuacucuggcagaaauguucacaacgugcaucuggccccugcaguagcuccaaccuuucccggugaacaguuacuguucuuuagguccacuaugccuggguguagcggcuaucccaauauggaccucgauugccuucugccacaggaguggguccagcacuucuaccaagaggcggccccugcacagucggacguggcuuugcuacgguuuguuaaccccgauacgggacgugugcuguucgaauguaaacuccauaagucuggcuaugucacaguggcccacaccgggcagcacgaccugguaauuccaccgaacggauacuuucgcuucgauuccugggugaaucaguucuauacucuugcaccuauggguaacggcaccgggagaaggcgggcccuguga

SEQ ID NO: 18686 - RNA, 1623 nt, Artificial Sequence; identical to SEQ ID NO: 17660
  derived and/or modified sequence opt3 from VP1__Norovirus__BAG70485

SEQ ID NO: 18687 - RNA, 1623 nt, Artificial Sequence; identical to SEQ ID NO: 17660
  derived and/or modified sequence opt3 from VP1__Norovirus__BAG70488

SEQ ID NO: 18688 - RNA, 1623 nt, Artificial Sequence
  derived and/or modified sequence opt3 from VP1__Norovirus__BAG70491
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcgagggcacaaggcuaccguuuccacaggaucaguggauuuuacuccuaaacuggguagcguccaauucgccaccgacacagauaacgacuuugagacuggccagaauaccagauucacaccagugggggucauccaggauggaaguucuacccauaggaacgaaccccaacaguggguguugccggacuacuccggccggacugcucacaauguucaccucgccccugcaguggccccaacguuucccggugagcagcuguuauucuuucguagcacaaugccuggguguucgggcuaccccaacauggaucuggacugccuccuuccacaggaauggguacaacauuucuaucaggaggcugcgccuucucaguccgaugucgcacuguugcgcuuugugaaucccgacaccggaagaguucuauucgaguguaagcugcacaaagccggcuacgugacugucgcucauaccgggcagcacgaucucgugauuccaccgaacggauauuuuagguucgacucauggguaaaucaauucuacacacuggccccuauggguaacggcgcagggcggcgacgcgcccuuuga

SEQ ID NO: 18689 - RNA, 1623 nt, Artificial Sequence
  derived and/or modified sequence opt3 from VP1__Norovirus__BAG70494
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacgggacuacaccaugaaucucgcuagucugaacuggaauaacuaugauccgacggaagagauucccgccccucuugggacuccagacuucguaggaaagauccagggcguucugacacagaccacuaagggcgacgggagcacacgcggacacaaggcuaccguguacacggguucugcccccuuuaccccuaaauugggcuccguccaguucucaacagauacugaaaaugacuuugagacccaucaaaacacaaaguucacuccagugggggucauccaggauggaagcaccacacaccgaaaugaaccccagcaaugggugcucccgaguuacucuggcagaaacguucacaaugugcaucuggccccugcaguagcuccaaccuuucccggugagcaguuacuguucuuuagguccacuaugccuggguguagcggcuaucccaacauggaccucgauugccuucugccacaggaguggguccagcacuucuaccaagaagcggccccugcacagucggacguggcuuugcuacgguuuguuaaucccgauacgggacgugugcuguucgaguguaaacuccauaagucuggcuaugucacaguggcccacaccgggcagcacgaccugguaauuccaccgaacggauacuuucgcuucgauuccugggugaaccauuucuauacucuugcaccuauggguaauggcaccgggagaaggcgggcccuguga

SEQ ID NO: 18690 - RNA, 1623 nt, Artificial Sequence; identical to SEQ ID NO: 17982
  derived and/or modified sequence opt3 from VP1__Norovirus__BAG70497

SEQ ID NO: 18691 - RNA, 1623 nt, Artificial Sequence; identical to SEQ ID NO: 18152
  derived and/or modified sequence opt3 from VP1__Norovirus__BAG70503

SEQ ID NO: 18692 - RNA, 1623 nt, Artificial Sequence; identical to SEQ ID NO: 17982
  derived and/or modified sequence opt3 from VP1__Norovirus__BAG70506

SEQ ID NO: 18693 - RNA, 1623 nt, Artificial Sequence
  derived and/or modified sequence opt3 from VP1__Norovirus__BAG70509
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguacccggaauuacacgaugaaccucgcuucacugaauuggaacaauuaugacccgacugaagagauucccgccccucuugggacaccagauuucguaggaaagauccagggcguucugacccagacuacaaagggcgacgggaguacccgcggacacaaggcuacgguguacaccgguagcgcccccuuuacaccuaaauugggcucuguccaguucuccacugacaccgaaaacgauuuugagacacaucaaaauacuaaguucaccccagugggggucauccaggacggaggcacaacccaccgaaacgaaccccagcaaugggugcucccgucauacagcgguagaaauguucacaacgugcaucuggccccugcaguagcuccaacuuuucccggggagcaguuacuguucuuuaggaguacgaugccuggcuguucuggauaucccaauaugaaccucgauugccuucugccacaggaguggguccagcacuucuaccaagaagcggccccugcacaguccgacguggcuuugcuacgguuuguuaaccccgauacaggccgugugcuguucgaguguaaacuccauaagagcggguaugucaccguggcccacacuggacagcacgaccugguaauuccaccgaaugguuacuuucgcuucgauucgugggugaaccaguucuauacccuugcaccuaugggcaaugggacaggaagaaggcgggcccuguga

SEQ ID NO: 18694 - RNA, 1623 nt, Artificial Sequence
  derived and/or modified sequence opt3 from VP1__Norovirus__BAG70512
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguacccggaauuacacgaugaaccucgcuucacugaguuggaauaacuaugacccgacugaagagauucccgccccucuugggacaccagauuucguaggaaagauccagggcguucugacccagacuacaaagggcgacgggagcacccgcggacacaaggcuacgguguacaccgguucugcccccuuuacaccuaaauugggcuccguccaguucucaacugacaccgaaaaugauuuugagacacaucaaaacacuaaguucaccccagugggggucauccaggacggaggcacaacccaccgaaaugaaccccagcaaugggugcucccgagcuacagugguagaaacguucacaaugugcaucuggccccugcaguagcuccaacuuuucccggggagcaguuacuguucuuuaggucuacgaugccuggcuguuccggauaucccaacauggaucucgacugccuucugccacaggaguggguccagcacuucuaccaagaagcggccccugcacagagcgauguggcuuugaugcgguuuguuaaucccgacacaggccgugugcuauucgaguguaaacugcauaagucgggguaugucaccguggcccacacuggacagcacgaucucguaauuccaccgaacgguuacuuucgcuucgacucuugggugaaccaguucuauacccuggcaccuaugggcaaugggacaggaagaaggcgggcccuuuga

SEQ ID NO: 18695 - RNA, 1623 nt, Artificial Sequence
  derived and/or modified sequence opt3 from VP1__Norovirus__BAG70515
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaaaauccagggccuguugacacagaccacuaagggcgacgggagcacacgcggacacaaggcuaccguuuacacggguucugcccccuuuaccccuaaacucggcuccgugcaguucucaacagacacugaaaacgauuuugagacccaucaaaauacaaaguucacuccagucggggugauccaggacggaagcaccacacaccgaaacgaaccccagcaauggguccugccgaguuacucuggcagaaaugugcacaacguucauuuagccccugcaguggcuccaaccuuucccggugagcagcuucucuucuuuagguccacuaugccuggguguagcggcuaucccaauauggaucuugacugccuguugccacaggaguggguacagcacuucuaccaagaagcggccccugcacagucggaugucgcucuacugcgguuugugaaccccgacacgggacguguucucuucgaguguaaacugcauaagucuggcuaugugacagucgcccacaccgggcagcacgaucuugugauuccaccgaacggauacuuucgcuucgacuccuggguaaaucaguucuauacucuggcaccuauggguaacggcaccgggagaaggcgggccuuguga

SEQ ID NO: 18696 - RNA, 1623 nt, Artificial Sequence; identical to SEQ ID NO: 18695
  derived and/or modified sequence opt3 from VP1__Norovirus__BAG70518

SEQ ID NO: 18697 - RNA, 1623 nt, Artificial Sequence
  derived and/or modified sequence opt3 from VP1__Norovirus__BAG70521
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccgucuuaacaguggaggaaaugaccaauucccgcuuuccaaucccccuggagaaacuuuucacggggccuucaagugcguucguugugcagccacagaacggaagauguacuaccgauggugucuugcugggcacaacucaacuaagcccggugaauauaugcaccuuuaggggagacguaacacauauugccgggacccaggaguacacgaugaaccucgcaucucagaauuggaacaauuaugaucccacugaagagaucccugcuccacugggcacacccgacuucguugguaagauucagggggugcuuacccaaacuacacggcgcgacggauccacccgaggccacaaggccacggucucaaccggcagcgugcauuuuacaccuaagcuggggagaauccaguucaguacugauaccucuaacgacuuugaaacaggacagaauacuagguucaccccagucggugugguucaagauggcgggacaacccaccagaacgagccccagcaguggguguugccgaauuacuccggacgggacagccacaacguacaucucgcuccugccgucgcaccaucguuucccggcgaacaacuguuauucuuucguucuacuaugccugguuguuccggguaccccaauaugaaccuggauugccuccuuccacaggagugggugcagcacuucuaucaggaggccgcuccugcgcaaucagacguugcacuguugcgcuuugugaaucccgauacgggcagaguccuauucgaauguaaacugcauaagaguggauacgugacaguagcccacaccggccagcacgaccucgugaucccaccgaacggguauuuuagguucgauagcuggguuaaccaguucuacacucuggcuccuaugggaaaugguaccggccggcgacgcgcccuuuga

SEQ ID NO: 18698 - RNA, 1623 nt, Artificial Sequence
  derived and/or modified sequence opt3 from VP1__Norovirus__BAG70524
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggccuguugacacagaccacuaagggcgacgggagcacacgcggacacaaggcuaccguuuacacggguucugcccccuuuaccccuaaacucggcuccgugcaguucucaacagacacugaaaacgauuuugagacccaucaaaauacaaaguucacuccagucggggugauccaggacggaagcaccacacaccgaaacgaaccccagcaauggguccugccgaguuacucuggcagaaaugugcacaacguucauuuagccccugcaguggcuccaaccuuucccggugagcagcugauuuucuuuagguccacuaugccuggguguagcggcuaucccaauauggaucucgacugccuucugccacaggaguggguacagcacuucuaccaagaagcggccccugcacagucggaugucgcuuugcuacgguuugugaaccccgacacgggacguguucuguucgaguguaaacuccauaagucuggcuaugugacagucgcccacaccgggcagcacgaucuggugauaccaccgaacggauacuuucgcuucgacuccuggguaaaucaguucuauacucuugcaccuauggguaacggcaccgggagaaggcgggcccuguga

SEQ ID NO: 18699 - RNA, 1623 nt, Artificial Sequence
  derived and/or modified sequence opt3 from VP1__Norovirus__BAG70527
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacagcuaugacccgacggaagagauucccgccccucuugggacuccagauuucguaggaaaaauccagggccuguugacacagaccacuaagggcgacgggucuacacgcggacacaaggcuaccguuuacacggguuccgcccccuuuaccccuaaacucggcucagugcaguucagcacagacacugaaaaugauuuugagacccaucaaaacacaaaguucacuccagucggggugauccaggacggaaguaccacacaccgaaaugaaccccagcaauggguccugccgucuuacuccggcagaaacgugcacaauguucauuuagccccugcaguggcuccaaccuuucccggugagcagcuucucuucuuuaggagcacuaugccuggguguucgggcuaucccaacauggaucuugacugccuguugccacaggaguggguacagcacuucuaccaagaagcggccccugcacagucugaugucgcucuacugcgguuugugaaucccgacacgggacguguucucuucgaguguaaacugcauaaguccggcuaugugacagucgcccacaccgggcagcacgaucuugugauuccaccgaacggauacuuucgcuucgacucauggguaaaccaguucuauacucuggcaccuauggguaauggcaccgggagaaggcgggccuuguga

SEQ ID NO: 18700 - RNA, 1623 nt, Artificial Sequence; identical to SEQ ID NO: 18695
  derived and/or modified sequence opt3 from VP1__Norovirus__BAG70530

SEQ ID NO: 18701 - RNA, 1623 nt, Artificial Sequence; identical to SEQ ID NO: 18695
  derived and/or modified sequence opt3 from VP1__Norovirus__BAG70533

SEQ ID NO: 18702 - RNA, 1623 nt, Artificial Sequence; identical to SEQ ID NO: 18695
  derived and/or modified sequence opt3 from VP1__Norovirus__BAG70536

SEQ ID NO: 18703 - RNA, 1623 nt, Artificial Sequence; identical to SEQ ID NO: 18261
  derived and/or modified sequence opt3 from VP1__Norovirus__BAI70518

SEQ ID NO: 18704 - RNA, 1623 nt, Artificial Sequence
  derived and/or modified sequence opt3 from VP1__Norovirus__BAJ13508
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggaacaauuacgauccgacugaggaaauucccgccccucuggguacaccagacuuuguagggaagauccagggaaugcuuacccagacuacacgaagcgacggcucuaccagaggccacaaagcuacgguucugaccggguccgccgauuucgcacccaaguugggaagggugcaauuugccacagacacugauaacgacuucgagucaggucagaauaccaaguuuacaccugucggcgugauccaggaugggagcacuacccaucggaacgaaccacaacaguggguccuccccaauuacaguggacguacaggccacaacgugcaccuggcuccggcgguugcaccuaccuauccaggugagcaguuacuguucuuucgcucuacuaugcccggguguuccggcuacccuaauauggaccucgauugccuucugccccaggaaugggugcaacauuucuaucaggaggccgcuccagcccagagcgacauggcauugcuaagauuuguaaacccugauacgggaaggguccuguucgaguguaaacuccacaagucgggcuacgugacaguugcccauaccgggcagcacgaccuggugauucccccaaacggauauuuucgguucgauucuugggucaaucaauuuuacacucuugcuccgauggguaacggcaccgggcgacgcagagccguguga

SEQ ID NO: 18705 - RNA, 1623 nt, Artificial Sequence
  derived and/or modified sequence opt3 from VP1__Norovirus__BAJ13513
augaagauggccagcuccgacgcuaaucccccugauggcucugcagccaaccuggugccagaggucaacaaugaaguuauggcgcucgagccggugguaggggcugccaucgcagcccccguggcuggacagcaaaacgucauugacccuuggauaagaaauaacuucgugcaggcaccagguggcgaauuuaccguuucacccaggaaugccccuggggagauccuuuggagugcuccacugggacccgauuugaacccuuacuuaagccaccuggcccggauguauaauggcuacgcggguggguucgaagugcaggucauucuagcaggaaacgccuuuacagcuggcaaaaucauuuucgccgcagugccaccgaauuuucccacugagggccucuccccuucucagguaacgauguucccacauaucauaguugacgugcgccaacuggagcccguccuuaucccucugccagaugugcgaaacaauuuuuaucacuacaaccagucgaaugacucaaccauuaaguugaucgcuaugcucuauacaccccugcgugccaacaacgcgggggaagauguguucacugucagcugcagaguucugaccaggccgaguccugacuuugauuucauuuuucucgugcccccaacaguagagucccggaccaaaccuuucacugugcccaucuuaacagucgaagagaugaccaauucucgcuuuccaauaccccuggagaaacuuuucacgggaccuagcggugccuucgugguucagccacagaacggcagauguacuaccgacgggguguugcugggaacaacucaacuauccccggucaauauuugcaccuuuaggggcgaugcaacacauaucgcugguucacggaguuacaccaugaaccucgccagccugaauuggaacaauuaugaccccacggaagagauuccugcuccacuugggacucccgauuucgugggaaagauccagggcaugcugacacagaccacuaagggcgacgggucuacacgcggacacaaggccaccguauacacggguuccgcaccuuuuaccccaaaauugggcucaguucaguucagcacagacacugaaaacgauuuucaaacccaucagaauacaaaguucacucccgugggggucauccaggacggaaguaccacacaccgaaacgagccgcaacagugggugcucccuucuuacuccggcagagauguccacaaugugcaucuggccccagcuguugcgcccaccuuuccuggugaacaguuacuguucuuuaggagcacuaugcccggguguucgggcuauccaaacauggaccucgauugccuucugccucaggagugggugcaacacuucuaccaggaggcagcccccgcucagucugacguagccuugcuacgguuugucaauccagauacgggacgugugcuguucgaauguaaacuccauaaguccggcuauguuacaguggcacacaccgggcagcacgaccuggucauuccgccuaacggauacuuucgcuucgauucaugggugaaucaauucuauacucuugcccccauggguaacggcaccgggagaaggcgggcucuguga

SEQ ID NO: 18706 - RNA, 1623 nt, Artificial Sequence
  derived and/or modified sequence opt3 from VP1__Norovirus__BAJ13520
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcaugcugacacagaccacuaagggcgacgggucuacacgcggacacaaggcuaccguuuacacggguuccgcccccuuuaccccuaaauugggcaaugugcaguucucaacagacacugaaaacgauuuugagacccaucaaaauacaaaguucacuccagucggggugauccaggacggaagcaccacacaccgaaacgaaccccagcaauggguccucccgaguuacucuggcagagaugugcacaauguucaucuggccccugcaguggcuccaaccuuucccggugagcaguuacuguucuuuagguccacuaugccuggguguagcggcuaucccaacauggaccucgauugccuucugccacaggaguggguacagcacuucuaccaagaagcggccccugcacagucggacgucgcuuugcuacgguuugugaaucccgauacgggacguguucuguucgaguguaaacuccauaagucuggcuaugugacagucgcccacaccgggcagcacgaccuggugauuccaccgaacggauacuuucgcuucgauuccuggguaaaccaguucuauacucuugcaccuauggguaauggcaccgggagaaggcgggcccuguga

SEQ ID NO: 18707 - RNA, 1623 nt, Artificial Sequence
  derived and/or modified sequence opt3 from VP1__Norovirus__BAJ13534
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgucagacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugagacccaucaaaacacaaaguucacuccagugggggucauccaggacggaaguaccacacaccgaaaugaaccccagcaaugggugcucccgucuuacuccggcagaaacguucacaaugugcaucuggccccugcaguagcuccaaccuuucccggugagcaguuacuguucuuuaggagcacuaugccuggguguucgggcuaucccaacauggaucucgacugccuucugccacaggaguggguccagcacuucuaccaagaagcggccccugcacagucugauguggcuuugcuacgguuuguuaaucccgacacgggacgugugcuguucgaguguaaacuccauaaguccggcuaugucacaguggcccacaccgggcagcacgaucugguaauuccaccgaacggauacuuucgcuucgacucaugggugaaccaguucuauacucuugcaccuauggguaauggcaccgggagaaggcgggcccuguga

SEQ ID NO: 18708 - RNA, 1623 nt, Artificial Sequence
  derived and/or modified sequence opt3 from VP1__Norovirus__BAJ13537
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucgugcuagcgggaaacgcauuuacugccggcaaaauuaucuucgcugccguaccuccaaauuuuccgacggagggccucucucccucgcagguuaccauguucccucauauuaucguggacguccgccaacuggagccagugcuuauaccccugccugaugugcgaaacaauuuuuaucacuacaaccagucaaaugacccaacaaucaaguugauugcaaugcucuauacuccccugcgugcuaacaacgccggggaugacgucuucaccguuagcugcagagugcugacaaggccgaguccugauuuugacuucaucuuucucguacccccaaccguggaaucccggacuaaaccuuucucuguccccauuuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuaccggcagccggaacuacacgaugaaucucgccacucagaacuggaacucuuaugaucccacagaggaaaucccugcaccacuggguacccccgacuucguugggaagauucagggagugcuuacucagacaacccgcgcugacggcuccacgcgaggccacaaggccaccgucuacacagggucagcugauuuugccccuaagcugggaagagugcaauucgcaacugacaccgauaaugacuuugaugccaaucagaacacaaaauucacuccagucggugugauccaggacggcgauaccgcucauaggaaugagccccaacaguggguuuugccgagcuacagugggcggaacaaucacaacgugcaccucgcgccugcaguagccccaacauuucccggagaacagcuguuauucuuucguucuaccaugccuggcuguuccgguuaucccaauauggaccuggauugccuccuuccacaggaguggguccaauacuucuaucaggaagcugccccugcacagagcgacguggcccuguugcgcuuuguuaaccccgauacugggagagugcuauucgaguguaagcugcauaaaucgggcuacgucacgguggcucacacaggacagcaugaccucguaaucccaccgaacggcuauuuuagguucgacucuugggugaaucaauucuacacccuggccccuauggggaacggaacuggucggcgacgcgcacuuuga

SEQ ID NO: 18709 - RNA, 1623 nt, Artificial Sequence
  derived and/or modified sequence opt3 from VP1__Norovirus__BAJ13540
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucguagguucacggaauuacacgaugaaccucgcaagucugaauuggaacaauuaugacccgacugaagagauucccgcuccucuugggacaccagauuucguuggaaagauccaaggcgugcugacccagacuacaaagggcgacgggagcacccgcggacacaaggccacggucuacaccgguucugcucccuuuacaccuaaauugggcuccgugcaguucucaacugacaccgaaaacgauuuugaggcccaucagaauacaaaguucacuccagucggggugauccaagacggaagcaccacacaccgaaacgaaccccagcaguggguucucccgaguuacucuggcagaaaugugcaaaacguacaccuggccccugcagucgcuccaaccuuucccggugagcaguuacuguucuuuagguccacuaugccuggguguagcggcuaucccaauauggaucucgacugccuucugccacaggagugggugcagcauuucuaccaagaagcggccccugcacagucggauguugcuuugcuacgguuugugaaccccgacacgggacguguccuguucgaguguaaacuccacaagucuggcuaugugacaguagcccauaccgggcagcacgaucuggugauuccaccgaacggauacuuucgcuucgacuccuggguuaaucaguucuauacucuugcaccuauggguaacggcaccgggagaaggcgggcccuguga

SEQ ID NO: 18710 - RNA, 1623 nt, Artificial Sequence; identical to SEQ ID NO: 18672
  derived and/or modified sequence opt3 from VP1__Norovirus__BAJ13543

SEQ ID NO: 18711 - RNA, 1623 nt, Artificial Sequence; identical to SEQ ID NO: 18672
  derived and/or modified sequence opt3 from VP1__Norovirus__BAJ13549

SEQ ID NO: 18712 - RNA, 1623 nt, Artificial Sequence
  derived and/or modified sequence opt3 from VP1__Norovirus__BAJ13552
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacggaauuacacgaugaaccucgcuagucugaauuggaacaauuaugacccgacugaagagauucccgccccucuugggacaccagauuucguaggaaagauccaaggcguucugacccagacuacaaagggcgacgggagcacccgcggacacaaggcuacgguguacaccgguucugcccccuuuacaccuaaauugggcuccguccaguucucaacugacaccgaaaacgauuuugaggcacaucagaauacaaaguucacuccagugggggucauccaagacggaagcaccacacaccgaaacgaaccccagcagugggugcucccgaguuacucuggcagaaauguucaaaacgugcaccuggccccugcuguagcgccaaccuuucccggugagcaguuacuguucuuuagguccacuaugccuggguguagcggcuaucccaauauggaucucgacugccuucugccacaggaguggguccagcauuucuaccaagaagcagccccugcucagucggauguggccuugcuacgguuuguuaaccccgacacgggacgugugcuguucgaguguaaacuccacaagucuggcuaugucacaguggcacauaccgggcagcacgaucugguaauuccaccgaacggauacuuucgcuucgacuccugggugaaucaguucuauacucuugccccuauggguaacggcaccgggagaaggcgggcucuguga

SEQ ID NO: 18713 - RNA, 1623 nt, Artificial Sequence
  derived and/or modified sequence opt3 from VP1__Norovirus__BAJ13555
augaagauggccagcaacgaccccuccccuucugauggcucagcugcaaaucuggugccagaggucaacaaugaaguuauggcccucgagccggugguaggggcggcuaucgccgcacccguggccggacagcaaaacgucauugacccuuggauaagaaauaacuucgugcaggcuccagguggcgaauuuaccguuagucccaggaaugcaccuggggagauccuuuggagcgccccacugggacccgauuugaacccuuacuuaucccaccuggcucggauguauaauggcuacgccgguggguucgaagugcaggucauucuagcgggaaacgcauuuacagccggcaaaaucauuuucgcugccgugccaccgaauuuucccacugagggccucucuccuucgcagguaacgauguucccacauaucauaguugacgugcgccaacuggagcccguccuuaucccucugccagaugugcgaaacaauuuuuaucacuacaaccagucaaaugacagcaccauuaaguugaucgcaaugcucuauacaccccugcgugcuaacaacgccggggaagauguguucacugucaguugcagaguucugaccaggccguccccugacuuugauuucauuuuucucgugcccccaacaguagagucucggaccaaaccuuucacugugcccaucuuaacagucgaagagaugaccaauagccgcuuuccaauaccccuggagaaacuuuucacgggaccuuccucagcguucgugguucagccacagaacgguagauguacuaccgacggcguguugcuggggacaacucaacuaaguccggucaauauuugcaccuuuaggggagaugugacacauaucgccggcagccggaacuacaccaugaaucucgcaucucugaacuggaauaacuaugaccccacggaagagauuccugcuccacuugguacucccgauuucguagggaagauccagggaguucugacacagaccacuaagggcgacggcuccacacgcgggcacaaggccaccguguacacgggaucagcuccuuuuaccccaaaauuggguagcguccaguucaguacagacacugaaaaugauuuugagacccaucaaaacacaaaguucacucccgugggcgucauccaggacgggggaaccacacaccgaaaugaaccgcagcaaugggugcucccuucuuacuccggcagagauguucagaacgugcaccuggccccagcaguagcccccaccuuuccuggugagcaguuacuguucuuuaggagcacuaugcccggguguucgggcuauccaaauauggaccucgauugccuucugccucaggaguggguccaacauuucuaccaggaagcugcgcccgcacagucugacguggccuugcuacgguuuguuaacccagauacgggacgugugcuguucgaguguaaacuccacaaguccggcuaugucacaguggcucauaccgggcagcacgaccugguaauuccgccuaauggauacuuucgcuucgauucaugggugaaccaauucuauacucuugcccccauggguaacggcaccgggagaaggcgggcacuguga

SEQ ID NO: 18714 - RNA, 1623 nt, Artificial Sequence; identical to SEQ ID NO: 18712
  derived and/or modified sequence opt3 from VP1__Norovirus__BAJ13558

SEQ ID NO: 18715 - RNA, 1623 nt, Artificial Sequence; identical to SEQ ID NO: 17982
  derived and/or modified sequence opt3 from VP1__Norovirus__BAJ13561

SEQ ID NO: 18716 - RNA, 1623 nt, Artificial Sequence
  derived and/or modified sequence opt3 from VP1__Norovirus__BAJ13564
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacauuaugaaccucgcuagccugaauuggaacaauuaugacccgaccgaagagauccccgccccucuugguacgccagauuucguagggaagauccagggaguucugacucagacaaccaagggcgacggcucuacucgcgggcacaaggcuacaguguacaccggauccgcccccuuuacgccuaaauuggguucaguccaguucagcaccgacacagaaaacgauuuugagacucaucaaaauaccaaguucacaccagugggcgucauucaggacgggaguacuacccaccgaaacgaaccccagcaaugggugcucccgucuuacuccggaagaaauguucacaacgugcaucuggccccugcaguagcuccaacauuucccggcgagcaguuacuguucuuuaggagcaccaugccugguuguucgggguaucccaauauggaucucgacugccuucugccacaggaguggguccagcacuucuaccaagaagcggccccugcacagucugauguggcuuugcuacgguuuguuaaccccgacacuggccgugugcuguucgaguguaaacuccauaaguccggauaugucacgguggcccacacaggccagcacgaucugguaauaccaccgaacggguacuuucgcuucgacucaugggugaaucaguucuauacccuugcaccuaugggaaacgguacuggcagaaggcgggcccuguga

SEQ ID NO: 18717 - RNA, 1623 nt, Artificial Sequence
  derived and/or modified sequence opt3 from VP1__Norovirus__BAJ13567
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucgggacuacaccaugaaucucgcuagccugaacuggaauaacuaugauccgacggaagagauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccgauucagcacagauacugaaaaugacuuugagacccaucagaacacaaaguucacuccagugggcgucauccaagaugggaguaccacacacagaaaugaaccccagcagugggugcucccgucuuacuccggaagggacguucacaacgugcaucuggccccugcaguagcuccaaccuuucccggcgagcaauuacuguucuuucggagcacuaugccugguuguucgggguaucccaauauggaucucgacugccuucugccacaggaguggguccagcacuucuaccaggaagcggccccugcacaaucugauguggcuuugcuacguuuuguuaaccccgacacgggccgcgugcuguucgaguguaaacuccauaagccaggauaugucacaguggcccacaccggccagcacgaucugguaauuccgccuaauggguacuuuagauucgacuccugggugaaccaguucuauacucuugcacccaugggaaacgguaccggcaggcggcgagcccuguga

SEQ ID NO: 18718 - RNA, 1623 nt, Artificial Sequence; identical to SEQ ID NO: 18712
  derived and/or modified sequence opt3 from VP1__Norovirus__BAJ13573

SEQ ID NO: 18719 - RNA, 1623 nt, Artificial Sequence
  derived and/or modified sequence opt3 from VP1__Norovirus__BAJ13576
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagaucccuuggagugaaccacuuggacccgaucugaauccuuacuugagccacuuagcucggauguauaacggcuacgccgguggguucgaggugcaggucauucuggcgggaaaugcauuuacagccggcaaaaucauuuucgcugccgugccaccgaacuuucccacugagggccuauccccuucucagguaacgauguucccacauaucauaguugacgugcgccaacucgaacccguccugaucccucuuccagaugugcgaaauaacuuuuaucacuacaaucagucgaacgacucaaccauuaagcugaucgcaauguuguauacaccccuccgugcuaacaaugccggggaggauguguucacugucagcugcagaguucugaccaggccgaguccugacuuugauuucauuuuucuggugcccccaacaguagaaucccggaccaaaccuuucacugugcccauccucacagucgaggagaugaccaacucucgcuuuccaauacccuuagaaaagcuguucacgggaccuagcuccgcguucgugguucagccacagaaugguagauguacuaccgacggcgugcuuuuggggacaacucaacugucaccggucaacauuugcaccuuuaggggagaugugacacauaucgccggcagucggaauuacaccaugaaccuagcaagccucaauuggaacaauuaugaccccacggaggaaauuccugcuccacuggguacucccgauuucguagggaaaauccagggaguucuuacacagaccacuaagggcgacggcucuacacgcgggcacaaggccaccguguacacgggauccgcugacuuuaccccuaaacuggguucaguccaguucagcacagauacugagaacgacuuugaaacccaucaaaauacaaaguucacuccagugggcgucauccaggaugggggaaccacacaccgaaacgagccccagcaauggguguugccgaguuacucuggcagaaauguucacaacgugcaucucgccccugcaguagccccaaccuuucccggugagcagcuguuauucuuuagguccacuaugccuggguguagcggcuaucccaauauggaccuggauugccuccuuccacaggaauggguccagcacuucuaccaagaggcugcgccugcacagucggacguggcccuguugcgguuuguuaaccccgauacgggacgugugcuauucgaauguaaacugcauaagucuggcuaugucacaguggcucacaccgggcagcacgaccucguaauuccaccgaacggauacuuucgcuucgauuccugggugaaucaguucuauacucuggccccuauggguaacggcaccgggagaaggcgggcacuuuga

SEQ ID NO: 18720 - RNA, 1623 nt, Artificial Sequence
  derived and/or modified sequence opt3 from VP1__Norovirus__BAJ13579
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgccgacuuuacccccaaauuggguucaguccaguucagcacagauacugaaaacgacuuugagacccaucaaaauacaaaguucacuccugugggcgucauccaggaugggggaaccacacaccgaaacgaaccacagcaaugggugcuccccaguuacucuggcagaaauguucacaacgugcaucuggcaccggccguagcuccuaccuuuccaggugagcaguuacuguucuuuagguccacuaugcccggguguagcggcuauccuaauauggaccucgauugccuucugccccaggaguggguccagcacuucuaccaagaagcggcaccagcccagucggacguggcuuugcuacgguuuguuaacccugauacgggacgugugcuguucgaguguaaacuccauaagucuggcuaugucacaguggcccacaccgggcagcacgaccugguaauucccccaaacggauacuuucgcuucgauuccugggugaaucaguucuauacucuugcaccgauggguaacggcaccgggagaaggcgggcccuguga

SEQ ID NO: 18721 - RNA, 1623 nt, Artificial Sequence; identical to SEQ ID NO: 18112
  derived and/or modified sequence opt3 from VP1__Norovirus__BAJ13582

SEQ ID NO: 18722 - RNA, 1623 nt, Artificial Sequence; identical to SEQ ID NO: 18261
  derived and/or modified sequence opt3 from VP1__Norovirus__BAJ13585

SEQ ID NO: 18723 - RNA, 1623 nt, Artificial Sequence
  derived and/or modified sequence opt3 from VP1__Norovirus__BAJ13591
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacucuauaagucuggcuacgucacaguggcccacaccgggcagcaugaucugguaauuccgccuaacggauauuuucgcuucgacuccugggugaaucaguucuacacucuugcacccauggguaacggcaccgggagaaggcgggcccuguga

SEQ ID NO: 18724 - RNA, 1623 nt, Artificial Sequence
  derived and/or modified sequence opt3 from VP1__Norovirus__BAJ13594
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcaugcugacacagaccacuaagggcgacgggucuacacgcggacacaaggcuaccguuuacacggguuccgcccccuuuaccccuaaauugggcucagugcaguucagcacagacacugaaaaugauuuugagacccaucaaaacacaaaguucacuccagucggggugauccaggacggaaguaccacacaccgaaaugaaccccagcaauggguccucccgucuuacuccggcagagaugugcacaacguucaucuggccccugcaguggcuccaaccuuucccggugagcaguuacuguucuuuaggagcacuaugccuggguguucgggcuaucccaauauggaccucgauugccuucugccacaggaguggguacagcacuucuaccaagaagcggccccugcacagucugacgucgcuuugcuacgguuugugaaccccgauacgggacguguucuguucgaguguaaacuccauaaguccggcuaugugacagucgcccacaccgggcagcacgaccuggugauuccaccgaauggauacuuucgcuucgauucauggguaaaccaguucuauacucuugcaccuauggguaacggcaccgggagaaggcgggcccuguga

SEQ ID NO: 18725 - RNA, 1623 nt, Artificial Sequence; identical to SEQ ID NO: 18712
  derived and/or modified sequence opt3 from VP1__Norovirus__BAJ13597

SEQ ID NO: 18726 - RNA, 1623 nt, Artificial Sequence
  derived and/or modified sequence opt3 from VP1__Norovirus__BAJ13603
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguuccuaaugugcaccuggcaccagccguagcucccaccuuuccuggugagcaguuacuguucuuuaggagcacuaugcccggguguucgggcuauccaaacauggaucucgacugccuucugccucaggaguggguccagcauuucuaccaagaagcggcacccgcccagucugauguggcuuugcuacgguuuguuaauccagacacgggacgugugcuguucgaguguaaacuccacaaguccggcuaugucacaguggcccauaccgggcagcacgaucugguaauuccgccuaacggauacuuucgcuucgacucaugggugaaccaguucuauacucuugcacccauggguaauggcaccgggagaaggcgggcccuguga

SEQ ID NO: 18727 - RNA, 1623 nt, Artificial Sequence
  derived and/or modified sequence opt3 from VP1__Norovirus__BAJ13606
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccgggacuacaccaugaaccucgcuucucugaauuggaacaauuaugauccgacggaagagauucccgccccucuugguacuccagacuucguagggaagauccagggaguucugacacagaccacuaagggcgacggcuccacacgcgggcacaaggcuaccguguacacgggaucagcccccuuuaccccuaaauuggguagcguccaguucaguacagauacuggcgacgauuuucaaacccaucagaacacaaaguucacuccagugggggucauccaggacggaggcaccacacaccgaaaugaaccccaacagugggugcucccgucuuacuccgguagaaacguuccuaaugugcaccuggcaccagccguagcucccaccuuuccuggggagcaguuacuguucuuuaggagcacuaugcccggcuguucgggauauccaaacauggaucucgacugccuucugccucaggaauggguccaacauuucuaccaggaggcggcacccgcccagucugauguggcuuugcuacgguuuguuaauccagacacgggccgugugcuguucgaguguaaacuccacaaggccggguaugucacaguggcacauaccggacagcacgaucugguaauuccgccuaacgguuacuuucgcuucgacuccugggugaaucaauucuauacucuugcccccaugggcaacgggaccggaagaaggcgggcucuguga

SEQ ID NO: 18728 - RNA, 1623 nt, Artificial Sequence
  derived and/or modified sequence opt3 from VP1__Norovirus__BAJ13609
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacauuaugaaccucgcuagccugaauuggaacaauuaugacccgaccgaagagauccccgccccucuugguacgccagauuucguagggaagauccagggaguucugacucagacaaccaagggcgacggcucuacucgcgggcacaaggcuacaguguacaccggauccgcccccuuuacgccuaaauuggguucaguccaguucagcaccgacacagaaaacgauuuugagacucaucaaaauaccaaguucacaccagugggcgucauucaggacgggaguacuacccaccgaaacgaaccccagcaaugggugcucccgucuuacuccggaagaaauguucacaacgugcaucuggccccugcaguagcuccaacauuucccggcgagcaguuacuguucuuuaggagcaccaugccugguuguucgggguaucccaauauggaucucgacugccuucugccacaggaguggguccagcacuucuaccaagaagcggccccugcacagucugauguggcuuugcuacgguuuguuaaccccgacacuggccgugugcuguucgaguguaaacuccauaaguccggauaugucacgguggcccacacaggccagcacgaucugguaauaccaccgaacggguacuuucgcuucgacucaugggugaaucaguucuauacccuuacuccuaugggaaacgguaccggcagaaggcgggcacuguga

SEQ ID NO: 18729 - RNA, 1623 nt, Artificial Sequence
  derived and/or modified sequence opt3 from VP1__Norovirus__BAJ13612
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugagacccaucaaaacacaaaguucacuccagugggggucauccaggacggaggcaccacacaccgaaaugaaccccagcaaugggugcucccgaguuacucugguagagauguucacaacgugcaucuggccccugcaguagcuccaaccuuucccggggagcaguuacuguucuuuagguccacuaugccuggcuguagcggauaucccaauauggaccucgauugccuucugccacaggaguggguccagcacuucuaccaagaagcggccccugcacagucggacguggcuuugcuacgguuuguuaaccccgauacgggccgugugcuguucgaguguaaacuccauaagucuggguaugucacaguggcccacaccggacagcacgaccugguaauuccaccgaaugguuacuuucgcuucgauuccugggugaaccaguucuauacucuugcaccuaugggcaacgggaccggaagaaggcgggcccuguga

SEQ ID NO: 18730 - RNA, 1623 nt, Artificial Sequence
  derived and/or modified sequence opt3 from VP1__Norovirus__BAJ13615
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaggcaccacacaccgaaacgaaccccagcaaugggugcucccgagcuacagugguagaaauguucacaacgugcaucuggccccugcaguagcuccaaccuuucccggggagcaguuacuguucuuuaggucuacuaugccuggcuguuccggauaucccaauauggaucucgacugccuucugccacaggaguggguccagcacuucuaccaagaagcggccccugcacagagcgauguggcuuugcuacgguuuguuaaccccgacacgggccgugugcuguucgaguguaaacuccauaagucgggguaugucacaguggcccacaccggacagcacgaucugguaauuccaccgaacgguuacuuucgcuucgacucuugggugaaucaguucuauacucuugcaccuaugggcaacgggaccggaagaaggcgggcccuguga

SEQ ID NO: 18731 - RNA, 1623 nt, Artificial Sequence
  derived and/or modified sequence opt3 from VP1__Norovirus__BAJ13618
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaauguucagaacgugcaccuggccccugcaguagcuccaaccuuucccggcgagcaguuacuguucuuuaggagcacuaugccugguuguucgggguaucccaauauggaucucgacugccuucugccacaggaguggguccaacauuucuaccaggaagcggccccugcacagucugauguggcuuugcuacgguuuguuaaccccgacacgggccgugugcuguucgaguguaaacuccacaaguccggauaugucacaguggcccauaccggccagcacgaucugguaauuccaccgaacggguacuuucgcuucgacucaugggugaaucaauucuauacucuugcaccuaugggaaacggugccggcagaaggcgggcucuguga

SEQ ID NO: 18732 - RNA, 1623 nt, Artificial Sequence; identical to SEQ ID NO: 17982
  derived and/or modified sequence opt3 from VP1__Norovirus__BAJ13621

SEQ ID NO: 18733 - RNA, 1623 nt, Artificial Sequence
  derived and/or modified sequence opt3 from VP1__Norovirus__BAJ13624
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgcagugcagccucagaaugguagauguacuaccgacggcguuuugcuggggacaacucaacuaucaccagugaacauuugcaccuuuaggggagaugucacacauaucgcuggcagucggaauuacaccaugaaccucgccagccugaauuggaacaauuaugacccgacggaagagauucccgcuccucuugguacuccagauuucguggggaagauccagggaguacugacacagaccacuaagggcgacggcucuacacgcgggcacaaggccaccguuuacacgggauccgcacccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguccucccgucuuacuccggaagaaaugugccuaacguucaccuggccccagcuguggcgcccaccuuuccuggcgagcaguuacuguucuuuaggagcacuaugcccgguuguucgggguauccaaauauggaucucgacugccuucugccucaggaguggguacagcauuucuaccaagaagcagcccccgcucagucugaugucgccuugcuacgguuugugaacccagacacgggccguguucuguucgaguguaaacuccacaaguccggauaugugacagucgcacauaccggccagcacgaucuggugauuccgccuaacggguacuuucgcuucgacucauggguaaaucaguucuauacucuugcccccaugggaaacgguaccggcagaaggcgggcucuguga

SEQ ID NO: 18734 - RNA, 1623 nt, Artificial Sequence
  derived and/or modified sequence opt3 from VP1__Norovirus__BAJ13627
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacgggacuacaccaugaaucucgcuagucugaacuggaauaacuaugauccgacggaagagauucccgccccucuugggacuccagacuucguaggaaagauccagggcguucugacacagaccacuaagggcgacgggagcacacgcggacacaaggcuaccguguacacggguucuacccccuuuacaccuaaauugggcuccguccaguucucaacugauaccgaaaaugacuuugagacacaucaaaacacuaaguucaccccagugggggucauccaggauggaagcacaacccaccgaaaugaaccccagcaaugggugcucccgaguuacucuggcagaaacguucagaaugugcaccuggccccugcaguagccccaacuuuucccggugagcaguuacuguucuuuagguccacgaugccuggguguagcggcuaucccaacauggaccucgauugccuucugccacaggaguggguccaacauuucuaccaggaagcugcgccugcacagucggacguggccuugcuacgguuuguuaaucccgauacaggacgugugcuguucgaguguaaacuccacaagucuggcuaugucaccguggcucauacugggcagcacgaccugguaauuccaccgaacggauacuuucgcuucgauuccugggugaaccaauucuauacccuugccccuauggguaauggcacagggagaaggcgggcacuguga

SEQ ID NO: 18735 - RNA, 1623 nt, Artificial Sequence
  derived and/or modified sequence opt3 from VP1__Norovirus__BAJ13630
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguuccuaaugugcaccuggcaccagccguagcucccaccuuuccuggugagcaguuacuguucuuuaggagcacuaugcccggguguucgggcuauccaaacauggaucucgacugccuucugccucaggaguggguccagcauuucuaccaagaagcggcacccgcccagucugauguggcuuugcuacgguuuguuaauccagacacgggacgugugcuguucgaguguaaacuccacaaggccggcuaugucacaguggcacauaccgggcagcacgaucugguaauuccgccuaacggauacuuucgcuucgacuccugggugaaccaguucuauacucuugcccccauggguaauggcaccgggagaaggcgggcucuguga

SEQ ID NO: 18736 - RNA, 1623 nt, Artificial Sequence
  derived and/or modified sequence opt3 from VP1__Norovirus__BAJ13633
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacacgauucacuccagugggcgucauccaggacgggggaaccacacacagaaacgaaccccagcaaugggugcucccgaguuacucuggcaggaauguuccuaacgugcaccuggcaccagccguagcucccaccuuuccuggugagcaguuacuguucuuucgguccacuaugcccggguguagcggcuauccaaauauggaucucgacugccuucugccucaggaguggguccagcauuucuaccaagaagcggcacccgcccagucggauguggcuuugcuacguuuuguuaacccagacacgggacgcgugcuguucgaguguaagcuccacaaaucuggcuaugucacaguggcccauaccgggcagcacgaucugguaauuccgccuaacggauacuuuagauucgacuccugggugaaucaguucuauacucuugcacccauggguaacggcaccgggaggcggcgaguuucauga

SEQ ID NO: 18737 - RNA, 1623 nt, Artificial Sequence; identical to SEQ ID NO: 18712
  derived and/or modified sequence opt3 from VP1__Norovirus__BAJ13636

SEQ ID NO: 18738 - RNA, 1623 nt, Artificial Sequence
  derived and/or modified sequence opt3 from VP1__Norovirus__BAJ13639
augaagauggccagcaacgacgcuaaucccuccgauggcucugcagccaaccuggugcaggaggucaauaacgaaguuauggcgcucgagccugugguaggggcugccaucgcagccccaguggcuggacaacagaaugucauugacccguggauaagaaacaauuucgugcaggcacccgguggcgaauuuaccguuucaccuaggaacgccccaggggagauccuuuggagugcuccccugggaccugauuugaauccauacuuaagccaccuggcccggauguauaacggcuacgcggguggguucgaagugcaggucauucuagcaggaaaugccuuuacagcuggcaaaaucauuuucgccgcagugcccccuaacuuuccaacugagggccucuccccgucucaaguaacgauguucccccauaucauaguugacgugcgccagcuggagccuguccuuaucccacugcccgaugugcgaaauaacuuuuaucacuacaaucagucgaacgacucaaccauuaaguugaucgcuaugcucuauacaccucugcgugccaacaaugcgggggaagauguguucacugucagcugcagaguucugaccaggccaagucccgacuuugauuucauuuuucucgugccgccuacaguagagucccggaccaaacccuucacugugccaaucuuaacagucgaagagaugaccaacucucgcuuuccuauaccccuggagaaacuuuucacgggaccaagcuccgccuucgugguucagccccaaaaugguagauguacuaccgacggcguguugcuggggacaacucagcuaucaccugucaacauuugcaccuuuaggggagaugugacacauaucgcaggcagucggaauuacauuaugaaccucgcuagccugaauuggaacaauuaugacccaaccgaagagaucccggcuccccuugguacgccugauuucguagggaagauccagggaguucugacucagacaaccaagggcgacggcucuacucgcgggcacaaggccacaguguacaccggauccgccccauuuacgcccaaauuggguucaguccaauucagcaccgacacagaaaacgauuuugagacucaucagaauaccaaguucacaccugugggcgucauucaggacgggaguacuacccaccgaaacgaaccacaacagugggugcuccccucuuacuccggaggcaauguucacaacgugcaucuggcaccggccguagcuccuacauuuccaggugagcaguuacuguucuuuagaagcaccaugcccggguguucgggcuauccuaauauggaucucgacugccuucugccccaggaguggguccaacacuucuaccaggaagcggcaccagcccagucugauguggcuuugcuaagguuuguuaacccugacacuggacgggugcuguucgaguguaaacuccauaaguccggcuaugucacgguggcccacacagggcagcacgaucugguaauacccccaaacggauacuuucguuucgacucaugggugaaucaauucuauacccuugcaccgauggguaacggcacugggcgcagaagggcccuguga

SEQ ID NO: 18739 - RNA, 1623 nt, Artificial Sequence; identical to SEQ ID NO: 18712
  derived and/or modified sequence opt3 from VP1__Norovirus__BAJ13642

SEQ ID NO: 18740 - RNA, 1623 nt, Artificial Sequence
  derived and/or modified sequence opt3 from VP1__Norovirus__BAJ13648
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaggcaccacacaccgaaacgaaccccagcaaugggugcucccgagcuacagugguagagauguucacaaugugcaucuggccccugcaguagcuccaaccuuucccggggagcaguuacuguucuuuaggucuacuaugccuggcuguuccggauaucccaacauggaccucgauugccuucugccacaggaguggguccagcacuucuaccaagaagcggccccugcacagagcgacguggcuuugcuacgguuuguuaaucccgauacgggccgugugcuguucgaguguaaacuccauaagucgggguaugucacaguggcccacaccggacagcacgaccugguaauuccaccgaacgguuacuuucgcuucgauucuugggugaaccaguucuauacucuugcaccuaugggcaaugggaccggaagaaggcgggcccuguga

SEQ ID NO: 18741 - RNA, 1623 nt, Artificial Sequence
  derived and/or modified sequence opt3 from VP1__Norovirus__BAJ13651
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccagugagauccuuuggagcgcuccucuggggccagauuugaaucccuacuuaucccaccuggcccggauguauaacggauacgcgggcgguuucgaagugcaggucauucuagcagggaaugccuuuacagcuggaaaaaucauuuucgccgcagugccuccaaacuuuccgacugagggccucucucccucgcagguaacgauguucccucauaucauaguugacgugcgccaacuggagccaguccuuaucccccugccugaugugcgaaauaacuuuuaucacuacaaucagucaaacgacagcaccauuaaguugaucgcuaugcucuauacaccacugcgugccaacaaugcgggcgaagauguguucacugucaguugcagaguucugaccaggcccuccccggacuuugauuucauuuuucucgugccucccacaguagagucucggaccaaaccauucacugugccuaucuuaacagucgaagagaugaccaacagccgcuuucccauaccacuggagaaacuuuucacggggcccuccucagccuucgugguucagccucagaauggaagauguacuaccgacgguguguugcugggcacaacucaacuaaguccagucaacauuugcaccuuuaggggagaugugacacauaucgcagggagccggaauuacaccaugaaccucgcuucuauuaauuggaacaauuaugacccgacggaagagauccccgccccucugggcacuccagauuucguagguaagauccaggggguucuuacacagaccacuaagggagacggcuccacacgcggccacaaggcuaccguguacacggggucagcccccuuuaccccuaaacugggaagcguccaguucaguacagacacugaaaacgauuuugagacccaucaaaauacaaaguucacuccagugggugucauucaggacggcgggaccacacaccagaacgaaccccaacaguggguguugccgggauacucuggccgaaauguuccuaacgugcaccucgcaccagccguagcucccaccuuuccuggugagcagcuguuauucuuuagauccacuaugcccggguguagcggcuauccaaauauggaucuggacugccuccuuccucaggaguggguccaacauuucuaccaggaagcggcacccgcccagucggauguggcucuguugagguuuguuaacccagacacgggacgggugcuauucgaguguaaacugcacaagucuggcuaugucacaguggcccauaccgggcagcacgaucucguaauaccgccuaacggauacuuucguuucgacuccugggugaaucaauucuauacucuggcacccauggguaacggcaccgggcgcagaagggcccuuuga

SEQ ID NO: 18742 - RNA, 1623 nt, Artificial Sequence
  derived and/or modified sequence opt3 from VP1__Norovirus__BAJ13654
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaaucgagucccggaccaaaccauucacuguaccuauauuaacaguggaagagaugaccaacucucgcuuucccauuccacuggagaaacuuuucacgggacccagcggugccuucgucgugcagccucagaauggcagauguacuaccgacgggguuuugcugggaacaacucaacuauccccagugaacaucugcaccuuuaggggcgaugucacacauauugcagguucacgggacuacaccaugaaucucgcuagucugaacuggaauaacuaugauccgacggaagagauccccgccccucuugggacuccagacuucgugggaaagauccagggcguacugacacagaccacuaagggcgacgggagcacacgcggacacaaggcuaccguuuacacggguucugcccccuuuaccccuaaauugggcuccgugcaguucucaacagauacugaaaaugacuuugagacccaucaaaacacaaaguucacuccagucggggugauucaggauggaagcaccacacaccgaaaugaaccccagcaauggguccucccgaguuacucuggcagaggugugcacaacguucaucuggccccugcaguggcuccaaccuuucccggggagcaguuacuguucuuuagguccacuaugccuggcuguagcggauaucccaauauggaccucgauugccuucugccacaggaguggguacagcacuucuaccaagaagcggccccugcacagucggacgucgcuuugcuacgguuugugaaccccgauacgggccguguucuguucgaguguaaacuccauaagucuggguaugugacagucgcccacaccggacagcacgaccuggugauaccaccgaaugguuacuuucgcuucgauuccuggguaaaccaguucuauacucuugcaccuaugggcaacgggaccggaagaaggcgggcccuguga

SEQ ID NO: 18743 - RNA, 1623 nt, Artificial Sequence
  derived and/or modified sequence opt3 from VP1__Norovirus__BAJ13657
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuucccugggaccugauuugaacccauacuuaucucaccuggcccggauguauaauggcuacgcggguggguucgaagugcaggucauucuagcaggaaacgccuuuacagcuggcaaaaucauuuucgccgcagugcccccuaauuuuccaacugagggccucucgccgucacagguaacgauguucccccauaucauaguugacgugcgccaacuggagccuguccuuaucccacugcccgaugugcgaaacaauuuuuaucacuacaaccagagcaaugacaguaccauuaaguugaucgcuaugcucuauacaccucugcgugccaacaacgcgggggaagauguguucacugucuccugcagaguucugaccaggccaucucccgacuuugauuucauuuuucucgugccgccuacaguagagagccggaccaaacccuucacugugccaaucuuaacagucgaagagaugaccaauucccgcuuuccuauaccccuggagaaacuuuucacgggaccaucaagugccuucgugguucagccccagaacgguagauguacuaccgacggcguguugcuggggacaacucaacuaagcccugucaauauuugcaccuuuaggggagaugugacacauaucgcaggcucucggaacuacaccaugaaucucgcuucccugaacuggaauaacuaugacccaacggaagagauuccggcuccccuugguacuccugauuucguagggaagauccagggaguucugacacagaccacuaagggcgacggcucaacacgcgggcacaaggccaccguguacacgggaagcgccccauuuacccccaaauuggguaguguccaguucucuacagacacugaaaaugauuuugagacccaucaaaacacaaaguucacuccugugggcgucauccaggacgggggaaccacacaccgaaaugaaccacagcaaugggugcuccccuccuacagcggcagaaacguucagaaugugcaccuggcaccggccguagcuccuaccuuuccaggugagcaguuacuguucuuuaggucgacuaugcccggguguucuggcuauccuaacauggaucucgacugccuucugccccaggaguggguccaacauuucuaccaggaagcggcaccagcccaguccgauguggcuuugcuacgguuuguuaauccugacacgggacgugugcuguucgaguguaaacuccacaagucaggcuaugucacaguggcccauaccgggcagcacgaucugguaauucccccaaacggauacuuucgcuucgacaguugggugaaccaauucuauacucuugcaccgauggguaauggcaccgggagaaggcgggcccuguga

SEQ ID NO: 18744 - RNA, 1623 nt, Artificial Sequence
  derived and/or modified sequence opt3 from VP1__Norovirus__BAJ13660
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagaucccuuggagugcuccacuuggacccgaucugaauccuuacuugagccacuuagcccggauguauaacggcuacgcggguggguucgaagugcaggucauucuggcaggaaaugccuuuacagcuggcaaaaucauuuucgccgcagugccaccgaacuuucccacugagggccuauccccuucucagguaacgauguucccacauaucauaguugacgugcgccaacucgagcccguccugaucccucuuccagaugugcgaaauaacuuuuaucacuacaaucagucgaacgacucaaccauuaagcugaucgcuauguuguauacaccccuccgugccaacaaugcgggggaagauguguucacugucagcugcagaguucugaccaggccgaguccugacuuugauuucauuuuucuggugcccccaacaguagagucccggaccaaaccuuucacugugcccauccucacagucgaagagaugaccaacucucgcuuuccaauacccuuagagaagcuguucacgggaccuagcuccgccuucgugguucagccacagaaugguagauguacuaccgacggcgugcuuuuggggacaacucaacugucaccggucaacauuugcaccuuuaggggagaugugacacauaucgcaggcagucgggacuacaccaugaaucuagcuagccucaacuggaauaacuaugaucccacggaagagauuccugccccacuggguacucccgacuucguagggaaaauccagggaguucuuacacagaccacuaagggcgacggcucuacacgcgggcacaaggcuaccguguacacgggauccgccccuuuuaccccaaaacuggguucaguccgauucagcacagauacugaaaaugacuuugagacccaucagaacacaaaguucacucccgugggcgucauccaagaugggaguaccacacacagaaaugaaccgcagcaguggguguugccuucuuacuccggaagggacguucacaacgugcaucucgcaccagccguagcucccaccuuuccuggcgagcaacuguuauucuuucggagcacuaugcccgguuguucgggguauccaaauauggaucuggacugccuccuuccucaggaguggguccagcacuucuaccaggaagcggcacccgcccaaucugauguggcucuguugcguuuuguuaacccagacacgggccgcgugcuauucgaguguaaacugcauaaguccggauaugucacaguggcccacaccggccagcacgaucucguaauuccgccuaauggguacuuuagauucgacucaugggugaaccaguucuauacucuggcacccaugggaaacgguaccggcaggcggcgagcccuuuga

SEQ ID NO: 18745 - RNA, 1623 nt, Artificial Sequence
  derived and/or modified sequence opt3 from VP1__Norovirus__BAJ13663
augaagauggccagcaacgacgcuaaucccuccgauggcucugcagccaaccuggugccugaggucaauaacgaagggauggcgcucgagccaguugugggagcugccaucgcagccccgguagcuggucagaccaaugugauugaccccuggauaagaaacaauuucguccaagcaccuggcggggaauuuacagugucaccaaggaacgcccccagugagauccuuuggagcgcuucccugggaccugauuugaauccauacuuaucucaccuggcccggauguauaacggcuacgcggguggguucgaaguucaggugauucuagcaggaaaugccuuuacugcuggcaaaaucauuuucgccgcagugcccccuaacuuuccaacggagggccucucgccgucacaggucaccauguucccccauaucauaguagacguucgccagcuggagccugugcuuaucccacugcccgauguccgaaauaacuuuuaucacuacaaucaaagcaacgacaguacaauuaaguugaucgcuaugcucuauacuccucugcgugccaacaaugcgggggaagauguguucaccguguccugcagaguccugacaaggccaucucccgacuuugauuucauuuuucucguuccgccuaccguggagagccggacuaaacccuucacaguaccaaucuuaaccguggaagagaugacgaacucccgcuuuccuauaccccuggagaaacuuuucacuggaccaucaggugccuucgucgugcagccccagaauggcagauguaccacagacgggguuuugcugggaacuacccagcuaaguccugugaacauuugcacauuuaggggcgaugucacccauaucgcagguagccggaauuacacgaugaaccucgcuucucugaauuggaacaauuaugacccaacugaagagauuccggcuccccuugggacaccugauuucgugggaaagauccaaggcguacugacccagacuacaaagggcaacggguccacccgcggacacaaggccacgguuuacaccgguucagccccauuuacacccaaauugggcagcgugcaguucaguacugacaccgaaaaugacuuugagacacaucagaacacuaaguucaccccugucggggugauccaagauggaucuacaacccaccgaaaugaaccacagcaguggguccuccccuccuacagcggcagaucggugcacaacguucaucuggcaccggccguggcuccuacuuuuccaggugagcaauuacuguucuuuaggucuacgaugcccggguguuccggcuauccuaauauggaccucgauugccuucugccccaggaguggguacagcacuucuaccaggaagcggcaccagcccaaucagacgucgcuuugcuacgguuugugaacccugauacaggacguguucuguucgaguguaaacuccauaagaguggcuaugugaccgucgcccacacugggcagcacgaccuggugauucccccaaacggauacuuucgcuucgauagcuggguaaaucaguucuauacccuugcaccgauggguaacggcacagggagaaggcgggcccuguga

SEQ ID NO: 18746 - RNA, 1623 nt, Artificial Sequence
  derived and/or modified sequence opt3 from VP1__Norovirus__BAJ13666
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagauaucacacauauugcaggcagucggaauuacaccaugaaccucgcuagccugaauuggaacaauuaugacccgacggaagagauccccgccccucuugguacuccagauuucguggggaagauccagggaguacugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauucaggacgggaguaccacacaccgaaacgaaccccagcaauggguccucccgucuuacuccggaagaaaugcacacaacgugcaucuggccccugcuguugcgccaaccuuucccggcgagcaguuacuguucuuuaggagcacuaugccugguuguucgggguaucccaauauggaucucgacugccuucugccacaggagugggugcagcacuucuaccaagaagcagccccugcucagucugauguagccuugcuacgguuugucaaccccgacacgggccgugugcuguucgaguguaaacuccauaaguccggauauguuacaguggcacacaccggccagcacgaucuggucauaccaccgaacggguacuuucgcuucgacucaugggugaaucaguucuauacucuugccccuaugggaaacgguaccggcagaaggcgggcucuguga

SEQ ID NO: 18747 - RNA, 1623 nt, Artificial Sequence
  derived and/or modified sequence opt3 from VP1__Norovirus__BAJ13669
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucggcacagacacugagaacgauuuugaaacccaucaaaauacaaaguucacuccugugggggucauccaggacggaagcaccacacaccgaaacgagccacagcaaugggugcuccccaguuacucuggcagaaauguucacaacgugcaucuggcaccggccguagcuccuaauuuuccaggugaacaguuacuguucuuuagguccaccaugcccggguguagcggcuauccuaacauggaucucgacugccuucugccccaggaguggguccagcacuucuaccaagaggcggcaccagcccagucggauguggcuuugcuacgguuuguuaacccugacacuggacgugugcuguucgaauguaaacuccauaagucuggcuaugucacgguggcccacacagggcagcacgaucugguaauucccccaaauggauacuuucgcuucgacuccugggugaaccaguucuauacccuugcaccgauggguaauggcacugggagaaggcgggcccuguga

SEQ ID NO: 18748 - RNA, 1623 nt, Artificial Sequence
  derived and/or modified sequence opt3 from VP1__Norovirus__BAJ13672
augaagauggccagcaacgacgcuaauagauccgauggcucugcagccaaccuggugcccgaggucaauaacgaaguuauggcgcucgagccugugguaggggcugccaucgcagccccaguggcuggacagcaaaaugucauugacccguggauaaggaacaauuucgugcaggcacccgguggcgaauuuaccguuucaccucggaacgccccaggggagauccuuuggagugcuccccugggaccugauuugaauccauacuuaagccaccuggcccgcauguauaacggcuacgcggguggguucgaagugcaggucauucuagcaggaaaugccuuuacagcuggcaaaaucauuuucgccgcagugcccccuaacuuuccaacugagggccucuccccgucucagguaacgauguucccccauaucauaguugacgugcgacaacuggagccuguccuuaucccacugcccgaugugcguaauaacuuuuaucacuacaaucagucgaacgacucaaccauuaaguugaucgcuaugcucuauacaccucugagagccaacaaugcgggggaagauguguucacugucagcugcaggguucugacccggccaagucccgacuuugauuucauuuuucucgugccgccuacaguagagucccgcaccaaacccuucacugugccaaucuuaacagucgaagagaugaccaacucuagauuuccuauaccccuggagaaacuuuucacgggaccaagcuccgccuucgugguucagccccagaaugguagguguacuaccgacggcguguugcuggggacaacucaacuaucaccugucaacauuugcaccuuucggggagaugugacacauaucgcaggcagucgcaauuacaccaugaaccucgcuagccugaauuggaacaauuaugacccaacggaagagauuccggcaccccuugguacuccugauuucguagggaagauccagggaguucugacacagaccacuaagggcgacggcucuacacgagggcacaaggcuaccguguacacgggauccgccccauuuacccccaaauuggguucaguccaguucagcacagacacugaaaacgauuuugagacccaucaaaauacaaaguucacuccugugggcgucauccaggacgggaguaccacacacagaucugaaccacagcaaugggugcuccccuccuacagcggaaggaacguuccgaaugugcaccuggccccugccguagcuccaaccuuucccggcgagcaguuacuguucuuucggucgacuaugccugguuguucuggguaucccaacauggaucucgacugccuucugccacaggaguggguccagcauuucuaccaagaagcggccccugcacaguccgauguggcuuugcuacguuuuguuaaucccgacacgggccgcgugcuguucgaguguaaacuccacaagucaggauaugucacaguggcccauaccggccagcacgaucugguaauuccaccgaacggguacuuuagauucgacaguugggugaaccaguucuauacucuugcaccuaugggaaaugguaccggcaggcggcgagcccuguga

SEQ ID NO: 18749 - RNA, 1623 nt, Artificial Sequence
  derived and/or modified sequence opt3 from VP1__Norovirus__BAJ13675
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacuccuacgcgggcgguuucgaagugcaggucauucuagcagggaaugccuuuacagcuggaaaaaucauuuucgccgcagugccuccaaacuuuccgacugagggccucucucccucgcagguaacgauguucccucauaucauaguugacgugcgccaacuggagccaguccuuaucccccugccugaugugcgaaauaacuuuuaucacuacaaucagucaaacgacagcaccauuaaguugaucgcuaugcucuauacaccacugcgugccaacaaugcgggcgaagauguguucacugucaguugcagaguucugaccaggcccuccccggacuuugauuucauuuuucucgugccucccacaguagagucucggaccaaaccauucacugugccuaucuuaacagucgaagagaugaccaacagccgcuuucccauaccacuggagaaacuuuucacggggcccuccucagccuucgugguucagccucagaauggaagauguacuaccgacgguguguugcugggcacaacucaacuaaguccagucaacauuugcaccuuuaggggagaugugacacauaucgcagggagccggaauuacaccaugaaccucgcuucucugaauuggaacaauuaugacccgacggaagagauucccgccccucuuggcacuccagauuucguagguaagauccaggggguucugacacagaccacuaagggagacggcuccacacgcggccacaaggcuaccguguacacggggucagcccccuuuaccccuaaauugggaagcguccaguucaguacagacacugaaaacgauuuugagacccaucaaaauacaaaguucacuccagugggugucauccaggacggcgggaccacacaccgaaacgaaccccagcaaugggugcucccgucuuacuccggaagagauguucacaaugugcaucuggccccugcaguagcuccaaccuuucccggcgagcaguuacuguucuuuaggagcacuaugccugguuguucgggguaucccaacauggaccucgauugccuucugccacaggaguggguccagcacuucuaccaagaagcggccccugcacagucugacguggcuuugcuacgguuuguuaaucccgauacgggccgugugcuguucgaguguaaacuccauaaguccggauaugucacaguggcccacaccggccagcacgaccugguaauuccaccgaacggguacuuucgcuucgauucaugggugaaccaguucuauacucuugcaccuaugggaaaugguaccggcagaaggcgggcccuguga

SEQ ID NO: 18750 - RNA, 1623 nt, Artificial Sequence
  derived and/or modified sequence opt3 from VP1__Norovirus__BAJ13678
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacgggacuacacgaugaaucucgcuagucugaacuggaauaacuaugauccgacugaagagauucccgccccucuugggacaccagacuucguaggaaagauccaaggcguucugacccagacuacaaagggcgacgggagcacccgcggacacaaggcuacgguguacaccgguucugcccccuuuacaccuaaauugggcuccguccaguucucaacugauaccgaaaaugacuuugaggcacaucagaacacaaaguucacuccagugggggucauccaagauggaagcaccacacaccgaaaugaaccccagcagugggugcucccgaguuacucuggcagaaacguucaaaaugugcaccuggccccugcuguagcgccaaccuuucccggugagcaguuacuguucuuuagguccacuaugccuggguguagcggcuaucccaacauggaccucgauugccuucugccacaggaguggguccagcauuucuaccaagaagcagccccugcucagucggacguggccuugcuacgguuuguuaaucccgauacgggacgugugcuguucgaguguaaacuccacaagucuggcuaugucacaguggcacauaccgggcagcacgaccugguaauuccaccgaacggauacuuucgcuucgauuccugggugaaccaguucuauacucuugccccuauggguaauggcaccgggagaaggcgggcucuguga

SEQ ID NO: 18751 - RNA, 1623 nt, Artificial Sequence
  derived and/or modified sequence opt3 from VP1__Norovirus__BAJ13681
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaagacacaaaguucacuccagugggcgucauccaggaugggggaaccacacaccgaaacgaaccccagcaaugggugcucccgucuuacuccggcagaaauguucagaacgugcaccuggccccugcaguagcuccaaccuuucccggugagcaguuacuguucuuuaggagcacuaugccuggguguucgggcuaucccaauauggaccucgauugccuucugccacaggaguggguccaacauuucuaccaggaagcggccccugcacagucugacguggcuuugcuacgguuuguuaaccccgauacgggacgugugcuguucgaguguaaacuccacaaguccggcuaugucacaguggcccauaccgggcagcacgaccugguaauuccaccgaauggauacuuucgcuucgauucaugggugaaccaauucuauacucuugcaccuauggguaacggcaccgggagaaggcgggcccuguga

SEQ ID NO: 18752 - RNA, 1623 nt, Artificial Sequence
  derived and/or modified sequence opt3 from VP1__Norovirus__BAJ13684
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucguaucucugaacuggaauaacuaugacccgacggaagagauucccgcuccucuugguacuccagauuucguugggaagauccagggagugcugacacagaccacuaagggcgacggcuccacacgcgggcacaaggccaccgucuacacgggaucagcucccuuuaccccuaaauuggguagcgugcaguucaguacagacacugaaaaugauuuugagacccaucaaaacacaaaguucacuccagucggcgugauccaggacgggucuaccacacaccgaaaugaaccccagcaauggguucucccguccuacagcggaagaaacgugcacaauguacaucuggccccugcagucgccccaaccuuucccggcgagcaguuacuguucuuuaggucgacuaugccugguuguucuggguaucccaacauggaucucgacugccuucugccacaggagugggugcagcacuucuaccaagaagcugcgccugcacaguccgauguugccuugcuacgguuugugaaucccgacacgggccguguccuguucgaguguaaacuccauaagucaggauaugugacaguagcuuacaccggccagcacgaucuggugauuccaccgaacggguauuuucgcuucgacaguuggguuaaccaguucuacacucuugccccuaugggaaaugguaccggcagaaggcgggcacuguga

SEQ ID NO: 18753 - RNA, 1623 nt, Artificial Sequence
  derived and/or modified sequence opt3 from VP1__Norovirus__BAJ13687
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucauugugcagccucagaaugguagauguacuaccgauggcguuuugcuggggacaacucaacuaucaccagugaacaucugcaccuuuaggggagacgucacacauauugcaggcagucggaauuacaccaugaaccucgcuagccugaauuggaacaauuaugauccgacggaggaaauccccgccccucuugguacuccagacuucguggggaagauccagggaguacugacacagaccacuaagggcgacggcucuacacgcgggcacaaggcuaccguuuacacgggauccgccgauuuuacccccaaauuggguucagugcaguucggcacagacacugagaacgauuuugaaacccaucaaaauacaaaguucacuccugucggggugauucaggacggaagcaccacacaccgaaacgagccacagcaauggguccuccccaguuacucuggcagaaaugugcacaacguucaucuggcaccggccguggcuccuaauuuuccaggugaacaguuacuguucuuuagguccaccaugcccggguguagcggcuauccuaacauggaucucgacugccuucugccccaggaguggguacagcacuucuaccaagaggcggcaccagcccagucggaugucgcuuugcuacgguuugugaacccugacacuggacguguucuguucgaauguaaacuccauaagucuggcuaugugacggucgcccacacagggcagcacgaucuggugauacccccaaauggauacuuucgcuucgacuccuggguaaaccaguucuauacccuugcaccgauggguaauggcacugggagaaggcgggcccuguga

SEQ ID NO: 18754 - RNA, 1623 nt, Artificial Sequence
  derived and/or modified sequence opt3 from VP1__Norovirus__BAJ13690
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccaguucagcacagauacugagaacgacuuugaaacccaucaaaauacaaaguucacuccagugggcgucauccaggaugggaguaccacacaccgaaacgagccccagcaaugggugcucccgucuuacuccggaagaaauguucacaacgugcaucuggccccugcaguagcuccaaccuuucccggcgaacaguuacuguucuuuaggagcacuaugccugguuguucgggguaucccaauauggaccucgauugccuucugccacaggaguggguccagcacuucuaccaagaggcggccccugcacagucugacguggcuuugcuacgguuuguuaaccccgauacgggccgugugcuguucgaauguaaacuccauaaguccggauaugucacaguggcccacaccggccagcacgaccugguaauuccaccgaacggguacuuucgcuucgauucaugggugaaucaguucuauacucuugcaccuaugggaaacgguaccggcagaaggcgggcccuguga

SEQ ID NO: 18755 - RNA, 1623 nt, Artificial Sequence
  derived and/or modified sequence opt3 from VP1__Norovirus__BAJ13693
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugaaagcaccugguggcgaauuuaccguuucaccaaggaacagucccggggagauccuuuggagcgccccucugggaccagauuugaaucccuacuuaucccaccuggcucggauguauaacggcuacgccgguggguucgaagugcaggucauucuagcgggaaaugcauuuacagccggcaagaucauuuucgcugccgugccuccaaacuuuccgacugagggccucucucccucgcagguaacgauguucccucauaucauaguugacgugcgccagcuggagccaguccuuaucccccugccugaugugcgaaauaacuuuuaucacuacaaucaaucaaacgacagcaccauuaaauugaucgcaaugcucuauacaccacugcgugcuaacaaugccggggaugacguguucacugucaguugcagaguucugaccaggcccuccccggauuuugacuucauuuuucucgugccucccacaguagaaucucggaccaagccauucacugugccuaucuuaacagucgaggaaaugaccaacagccgcuuucccauaccacuggagaaacuuuucacgggacccuccucagcguucauugugcagccucagaaugguagauguacuaccgauggcguuuugcuggggacaacucagcuaaguccagugaacaucugcaccuuuaggggagacgucacacauauugccggcagccggaauuacaccaugaaccucgcaucucugaauuggaacaauuaugauccgacggaggaagugcccgcuccucuugguacuccagacuucguagggaagauccaaggaguucugacacagaccacuaagggcgacggcuccacacgcgggcacaaagccaccguguacacgggaucagcugauuuuacccccaaguuggguagcguccaguucggcacagacacugagaacgauuuugaaacccaucagaauacaaaauucacuccugugggggucauccaagacggaaguaccacacaccgaaacgagccacagcagugggugcuccccucuuacuccggcagaaauguucacaacgugcaucuggccccggcaguagccccuaauuuuccaggugaacaauuacuguucuuuaggagcaccaugcccggguguucgggcuauccuaacauggaucucgacugccuucugccccaggaguggguccagcacuucuaccaggaggcugcgccagcacaaucugauguggccuugcuacgguuuguuaacccugacacuggacgugugcuguucgaauguaagcuccauaaauccggcuaugucacgguggcucacacagggcagcacgaucugguaauucccccaaauggauacuuucgcuucgacucaugggugaaccaguucuauacccuugccccgauggguaauggcacugggagaaggcgggcacuguga

SEQ ID NO: 18756 - RNA, 1623 nt, Artificial Sequence
  derived and/or modified sequence opt3 from VP1__Norovirus__BAJ13696
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacacgauucacuccagugggcgucauccaggacgggggaaccacacacagaaacgaaccccagcaaugggugcucccgaguuacucuggcaggaauguuccuaacgugcaccuggcaccagccguagcucccaccuuuccuggugagcaguuacuguucuuucgguccacuaugcccggguguagcggcuauccaaauauggaucucgacugccuucugccucaggaguggguccagcauuucuaccaagaagcggcacccgcccagucggauguggcuuugcuacguuuuguuaacccagacacgggacgcgugcuguucgaguguaagcuccacaaaucuggcuaugucacaguggcccauaccgggcagcacgaucugguaauuccgccuaacggauacuuuagauucgacuccugggugaaucaguucuauacucuugcacccauggguaacggcaccgggaggcggcgaguucuguga

SEQ ID NO: 18757 - RNA, 1623 nt, Artificial Sequence
  derived and/or modified sequence opt3 from VP1__Norovirus__BAJ13699
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcugcccugaauuggaacaauuaugacccgacggaagagauucccgcuccucuugggacuccagauuucguaggaaagauccagggcguucugacacagaccacuaagggcgacgggaguacacgcggacacaaggccaccguguacacggguagcgcagacuuuacccccaaauugggcucuguccaguucuccacagauacugaaaacgacuuugagacccaucaaaauacaaaguucacuccugugggggucauccaggauggaucaaccacacaccgaaacgaaccacagcaaugggugcuccccagcuacaguggcagaaauguucacaacgugcaucuggccccggcuguagcgccuaccuuuccaggugagcaguuacuguucuuuaggucuacuaugcccggguguuccggcuauccuaauauggaccucgauugccuuauuccccaggaguggguccagcacuucuaccaagaagcagccccagcucagagcgacguggcccuguugcgguuuguuaacccugauacgggacgugugcuauucgaguguaaacugcauaagucgggcuaugucacaguggcacacaccgggcagcacgaccucguaauacccccaaacggauacuuucgcuucgauucuugggugaaucaguucuauacucuggccccgauggguaacggcgcugggagaaggcgggcccuuuga

SEQ ID NO: 18758 - RNA, 1623 nt, Artificial Sequence
  derived and/or modified sequence opt3 from VP1__Norovirus__BAJ13702
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacggaauuacacgaugaaccucgcuagucugaauuggaacaauuaugacccgacugaagagauucccgccccucuugggacaccagauuucguaggaaagauccaaggcguucugacccagacuacaaagggcgacgggagcacccgcggacacaaggcuacgguguacaccgguucugcccccuuuacaccuaaauugggcuccguccaguucucaacugacaccgaaaacgauuuugaggcacaucagaauacaaaguucacuccagugggggucauccaagacggaagcaccacacaccgaaacgaaccccagcagugggugcucccgaguuacucuggcagaaaugcccaaaacguucaccuggcuccugcgguggcaccaaccuuucccggugagcaguuacuguucuuuagguccacuaugccuggguguagcggcuaucccaauauggaucucgacugccuucugccacaggaguggguacagcauuucuaccaagaagccgcuccugcccagucggaugucgcauugcuacgguuugugaaccccgacacgggacguguucuguucgaguguaaacuccacaagucuggcuaugugacagucgcccauaccgggcagcacgaucuggugauuccaccgaacggauacuuucgcuucgacuccuggguaaaucaguucuauacucuugcuccuauggguaacggcaccgggagaaggcgggcccuguga

SEQ ID NO: 18759 - RNA, 1623 nt, Artificial Sequence
  derived and/or modified sequence opt3 from VP1__Norovirus__BAJ13711
augaagauggccagcaacgacgcuaaucccuccgauggcucugcagccaaccuggugccugaggucaauaacgaaguuauggcgcucgagccagugguaggggcugccaucgcagccccgguggcugcacagcaaaaugucauugaccccuggauaagaaacaauuucgugcaggccccuggaggugaauuuaccguuucaccaaggaacgcucccagugagauccuuuggagcgccccucugggcccagauuugaaucccuacuuaucccacuucgcgcggauguauaacugcuacgcagggggauuugaagugcaggucauucuggccggcaaugcuuucacagccgguaaaaucauuuuugcagcugugccuccaaacuucccgacugaggggcuaucucccucgcagguaacgauguuuccucauaucauaguugacgugcgccaacucgagccaguccugaucccccuuccugaugugcgaaauaacuucuaucacuacaaucagucaaacgacagcaccauuaagcugaucgccauguuguauacaccacuccgugcgaacaaugccggagaagauguguuuacugucaguuguagaguucugaccaggcccuccccggacuucgauuuuauuuuccuggugccucccacaguagagucucggaccaaaccauuuacugugccuauccucacagucgaagagaugaccaacagccgcuuccccauaccauuagagaagcuguucacgggccccuccucagcauuugugguucagccucagaauggcagaugcacuaccgacggggugcuuuugggaacaacucaacugaguccagucaacauuuguaccuucaggggugaugugacacauaucgcuggcagccggaauuacaccaugaaccuagccucucucaauuggaacaauuaugacccgacggaagagauucccgcuccucuggggacuccagauuuuguaggaaaaauccagggcguucuuacacagaccacuaagggugacggguccacacgcggacacaaggccaccguguacacgggcucagcacccuucaccccuaaacugggcagcguccaguuuaguacagacacugaaaacgauuucgagacccaucaaaauacaaaguuuacuccagugggggucauccaggacggagguaccacacaccgaaacgaaccccagcaauggguguugccgucuuacuccggcagaaauguuccuaacgugcaccucgccccagcuguagcgcccaccuucccuggggagcagcuguuauuuuucaggagcacuaugcccggaugcucgggcuauccaaauauggaucuggacugucuccuuccucaggaguggguccagcauuuuuaccaagaagcagcccccgcucagucugauguggcccuguugcgguucguuaacccagacacgggucgugugcuauuugagugcaaacugcacaaguccggguaugucacaguggcacauaccggccagcacgaucucguaauuccgccuaacggauacuuccgcuucgacucaugggugaaucaguuuuauacucuggcccccaugggcaacgggaccggaagaaggcgggcucuuuga

SEQ ID NO: 18760 - RNA, 1623 nt, Artificial Sequence; identical to SEQ ID NO: 18724
  derived and/or modified sequence opt3 from VP1__Norovirus__BAJ13714

SEQ ID NO: 18761 - RNA, 1623 nt, Artificial Sequence
  derived and/or modified sequence opt3 from VP1__Norovirus__BAJ13717
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauguagcaggcagucggaauuacaucaugaaccucgcuagccugaauuggaacaauuaugacccgaccgaagagauucccgccccucuugguacgccagauuucguugggaagauccagggagugcugacucagacaaccaagggcgacggcucuacucgcgggcacaaggcuacagucuacaccggauccgcccccuuuacgccuaaauuggguucagugcaguucagcaccgacacagaaaacgauuuugagacucaucaaaauaccaaguucacaccagucggcgugauccaggacgggaguacuacccaccgaaacgaaccccagcaauggguucucccgucuuacuccggaagaaaugugcacaacguacaucuggccccugcagucgcuccaacauuucccggcgagcaguuacuguucuuuaggagcaccaugccugguuguucgggguaucccaauauggaucucgacugccuucugccacaggagugggugcagcacuucuaccaagaagcggccccugcacagucugauguugcuuugcuacgguuugugaaccccgacacuggccguguccuguucgaguguaaacuccauaaguccggauaugugacgguagcccacacaggccagcacgaucuggugauuccaccgaacggguacuuucgcuucgacucauggguuaaucaguucuauacccuugcaccuaugggaaacgguacuggcagaaggcgggcccuguga

SEQ ID NO: 18762 - RNA, 1623 nt, Artificial Sequence
  derived and/or modified sequence opt3 from VP1__Norovirus__BAJ13720
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacgugugcaccuuuaggggagauguaacacauauugcaggcagucggaauuacaccaugaaccucgcuagccugaauuggaacaauuaugacccgacggaagagauccccgccccucuugguacuccagauuucguugggaagauucagggagugcugacacagaccacuaagggcgacggcucuacacgcgggcacaaggcuaccgucuacacgggauccgcccccuuuaccccuaaauuggguucagugcaguucagcacagacacugaaaacgauuuugagacccaucaaaauacaaaguucacuccagucggcgugauccaggacgggggaaccacacaccgaaacgaaccccagcaauggguucucccgaguuacucuggcagagaugugccuaauguacaccuggcaccagccgucgcucccaccuuuccuggugagcaguuacuguucuuuagguccacuaugcccggguguagcggcuauccaaacauggaccucgauugccuucugccucaggagugggugcagcauuucuaccaagaagcggcacccgcccagucggacguugcuuugcuacgguuugugaauccagauacgggacguguccuguucgaguguaaacuccacaagucuggcuaugugacaguagcccauaccgggcagcacgaccuggugaucccgccuaacggauacuuucgcuucgauuccuggguuaaccaguucuauacucuugcacccauggguaauggcaccgggagaaggcgggcccuguga

SEQ ID NO: 18763 - RNA, 1623 nt, Artificial Sequence
  derived and/or modified sequence opt3 from VP1__Norovirus__BAJ13723
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccugucuuaacaguggaagagaugaccaacucucgcuuucccaucccacuggagaaacuuuucacgggacccagcuccgccuucguugugcagccucagaaugguagauguacuaccgacggcgucuugcuggggacaacucaacuaucaccagugaacauaugcaccuuuaggggagauguaacacauauugcaggcagucgggacuacaccaugaaucucgcuagccugaacuggaauaacuaugauccgacggaagagauccccgccccucuugguacuccagacuucguugggaagauucagggagugcugacacagaccacucgcggcgacggcucuacacgagggcacaaggcuaccgucuacacgggauccgcccccuuuaccccuaaguuggguucagugcaguucagcacagauacugaaaaugacuuugagacccaucaaaacacaaaauucacuccagucggcgugauccaggaugggggaaccacacacagaaaugaaccccagcaauggguucucccgaguuacucuggcaggaacgugccuaauguacaccuggcaccagccgucgcucccaccuuuccuggugagcaguuacuguucuuucgguccacuaugcccggguguagcggcuauccaaacauggaccucgauugccuucugccucaggagugggugcagcauuucuaccaagaagcggcacccgcccagucggacguugcuuugcuacguuuugugaauccagauacgggacgcguccuguucgaguguaagcuccacaaaucuggcuaugugacaguagcccauaccgggcagcacgaccuggugaucccgccuaacggauacuuuagauucgauuccuggguuaaccaguucuauacucuugcacccauggguaauggcaccgggaggcggcgagcccuguga

SEQ ID NO: 18764 - RNA, 1623 nt, Artificial Sequence
  derived and/or modified sequence opt3 from VP1__Norovirus__BAJ13726
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuaugucacaguggcccacaccgggcagcacgaucugguaauuccaccgaacggauacuuucgcuucgacuccugggugaaucaguucuauacucuugcaccuauggguaacggcaccgggagaaggcgggcccuguga

SEQ ID NO: 18765 - RNA, 1623 nt, Artificial Sequence; identical to SEQ ID NO: 18724
  derived and/or modified sequence opt3 from VP1__Norovirus__BAJ13729

SEQ ID NO: 18766 - RNA, 1623 nt, Artificial Sequence; identical to SEQ ID NO: 18675
  derived and/or modified sequence opt3 from VP1__Norovirus__BAJ13732

SEQ ID NO: 18767 - RNA, 1623 nt, Artificial Sequence; identical to SEQ ID NO: 17982
  derived and/or modified sequence opt3 from VP1__Norovirus__BAJ13738

SEQ ID NO: 18768 - RNA, 1623 nt, Artificial Sequence
  derived and/or modified sequence opt3 from VP1__Norovirus__BAJ13741
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagaaauguucacaacgugcaucuggccccugcaguagcuccaaccuuucccggugagcaguuacuguucuuuagguccacuaugccuggguguagcggcuaucccaauauggaucucgacugccuucugccacaggaguggguccagcacuucuaccaagaagcggccccugcacagucggauguggcuuugcuacgguuuguuaaccccgacacgggacgugugcuguucgaguguaaacuccauaagucuggcuaugucacaguggcccacaccgggcaguacgaucugguaauuccaccgaacggauauuuucgcuucgacuccugggugaaucaguucuacacucuugcaccuauggguaacggcaccgggagaaggcgggcccuguga

SEQ ID NO: 18769 - RNA, 1623 nt, Artificial Sequence; identical to SEQ ID NO: 18712
  derived and/or modified sequence opt3 from VP1__Norovirus__BAJ13744

SEQ ID NO: 18770 - RNA, 1623 nt, Artificial Sequence; identical to SEQ ID NO: 18202
  derived and/or modified sequence opt3 from VP1__Norovirus__BAJ13747

SEQ ID NO: 18771 - RNA, 1623 nt, Artificial Sequence; identical to SEQ ID NO: 18261
  derived and/or modified sequence opt3 from VP1__Norovirus__BAJ13750

SEQ ID NO: 18772 - RNA, 1623 nt, Artificial Sequence; identical to SEQ ID NO: 18202
  derived and/or modified sequence opt3 from VP1__Norovirus__BAJ13753

SEQ ID NO: 18773 - RNA, 1623 nt, Artificial Sequence
  derived and/or modified sequence opt3 from VP1__Norovirus__BAJ13756
augaagauggccagcuccgacgcuaaucccccugauggcucugcagccaaccuggugccagaggucaacaaugaaguuauggcgcucgagccggugguaggggcugccaucgcagcccccguggcuggacagcaaaacgucauugacccuuggauaagaaauaacuucgugcaggcaccagguggcgaauuuaccguuucacccaggaaugccccuggggagauccuuuggagugcuccacugggacccgauuugaacccuuacuuaagccaccuggcccggauguauaauggcuacgcggguggguucgaagugcaggucauucuagcaggaaacgccuuuacagcuggcaaaaucauuuucgccgcagugccaccgaauuuucccacugagggccucuccccuucucagguaacgauguucccacauaucauaguugacgugcgccaacuggagcccguccuuaucccucugccagaugugcgaaacaauuuuuaucacuacaaccagucgaaugacucaaccauuaaguugaucgcuaugcucuauacaccccugcgugccaacaacgcgggggaagauguguucacugucagcugcagaguucugaccaggccgaguccugacuuugauuucauuuuucucgugcccccaacaguagagucccggaccaaaccuuucacugugcccaucuuaacagucgaagagaugaccaauucucgcuuuccaauaccccuggagaaacuuuucacgggaccuagcggugccuucgugguucagccacagaacggcagauguacuaccgacgggguguugcugggaacaacucaacuauccccggucaauauuugcaccuuuaggggcgaugugacacauaucgcagguucacggaguuacaccaugaaccucgcuagccugaauuggaacaauuaugaccccacggaagagauuccugccccacuugggacucccgauuucguaggaaagauccagggcaugcugacacagaccacuaagggcgacgggucuacacgcggacacaaggcuaccguuuacacggguuccgccccuuuuaccccaaaauugggcucagugcaguucagcacagacacugaaaacgauuuucaaacccaucagaauacaaaguucacucccgucggggugauccaggacggaaguaccacacaccgaaacgagccgcaacaguggguccucccuucuuacuccggcagagaugugcacaauguucaucuggcaccagccguggcucccaccuuuccuggugaacaguuacuguucuuuaggagcacuaugcccggguguucgggcuauccaaacauggaccucgauugccuucugccucaggaguggguacaacacuucuaccaggaggcggcacccgcccagucugacgucgcuuugcuacgguuugugaauccagauacgggacguguucuguucgaauguaaacuccauaaguccggcuaugugacagucgcccacaccgggcagcacgaccuggugauuccgccuaacggauacuuucgcuucgauucauggguaaaucaauucuauacucuugcacccauggguaacggcaccgggagaaggcgggcccuguga

SEQ ID NO: 18774 - RNA, 1623 nt, Artificial Sequence
  derived and/or modified sequence opt3 from VP1__Norovirus__BAJ13759
augaagauggccagcaacgacgcuaaucccuccgauggcucugcagccucacuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaaaucauuuucgccgcagugccuccaaacuuuccgacugagggccucucgcccucacagguaacgauguucccucauaucauaguugacgugcgccaacuggagccaguccuuaucccccugccugaugugcgaaauaacuuuuaucacuacaaucagagcaacgacaguaccauuaaguugaucgcuaugcucuauacaccacugcgugccaauaacgcgggggaagauguguucacugucuccugcagaguucugaccaggcccucuccggacuuugauuucauuuuucucgugccucccacaguagagagccggaccaaaccauucacugugccuaucuuaacagucgaagagaugaccaacucccgcuuucccauaccacuggagaaacuuuucacgggacccucaggugccuucgugguucagccucagaauggcagauguacuaccgacgggguguugcugggaacaacucaacuaaguccagucaacauuugcaccuuuaggggcgaugugacacauaucgcagguagccggaauuacaccaugaaccucgcuucucugaauuggaacaauuaugacccgacggaagagauucccgccccucuugggacuccagauuucguaggaaagauccagggcguucugacacagaccacuaagggcgacggguccacacgcggacacaaggcuaccguguacacggguucagcccccuuuaccccuaaauugggcagcguccaguucaguacagacacugaaaacgauuuugagacccaucaaaauacaaaguucacuccagugggggucauccaggacggaucuaccacacaccgaaacgaaccccagcaaugggugcucccguccuacagcggcagagauguucacaaugugcaucuggccccugcaguagcuccaaccuuucccggugagcaguuacuguucuuuaggucgacuaugccuggguguucuggcuaucccaacauggaccucgauugccuucugccacaggaguggguccagcacuucuaccaagaagcggccccugcacaguccgacguggcuuugcuacgguuuguuaaucccgauacgggacgugugcuguucgaguguaaacuccauaagucaggcuaugucacaguggcccacaccgggcagcacgaccugguaauuccaccgaacggauacuuucgcuucgauaguugggugaaucaguucuauacucuugcaccuauggguaacggcaccgggagaaggcgggcccuguga

SEQ ID NO: 18775 - RNA, 1623 nt, Artificial Sequence; identical to SEQ ID NO: 18261
  derived and/or modified sequence opt3 from VP1__Norovirus__BAJ13762

SEQ ID NO: 18776 - RNA, 1623 nt, Artificial Sequence; identical to SEQ ID NO: 18261
  derived and/or modified sequence opt3 from VP1__Norovirus__BAJ13765

SEQ ID NO: 18777 - RNA, 1623 nt, Artificial Sequence; identical to SEQ ID NO: 18764
  derived and/or modified sequence opt3 from VP1__Norovirus__BAJ13768

SEQ ID NO: 18778 - RNA, 1623 nt, Artificial Sequence
  derived and/or modified sequence opt3 from VP1__Norovirus__BAJ13771
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcugcccugggaccugauuugaauccauacuuaagccaccuggcgcggauguauaacggcuacgccgguggguucgaagugcaggucauucuagcaggaaaugcuuuuacugccggcaaaaucauuuucgcagcugugcccccuaacuuuccaacggagggccucuccccgucucagguaaccauguucccccauaucauaguugacgugcgccagcuggagccuguccuuaucccacugcccgaugugcgaaauaacuuuuaucacuacaaucaaucgaacgacucaacaauuaaguugaucgccaugcucuauacuccucugcgugcgaacaaugccggggaagauguguucaccgucagcugcagaguucugacaaggccaagucccgacuuugauuucauuuuucucgugccgccuaccguagagucccggacuaaacccuucacagugccaaucuuaaccgucgaagagaugacgaacucucgcuuuccuauaccccuggagaaacuuuucacuggaccaagcggugcauucgugguucagccccagaauggcagauguaccacagacgggguguugcugggaacuacccagcuauccccugucaacauuugcacauuuaggggcgaugugacccauaucgcugguucacggaauuacacgaugaaccucgccagucugaauuggaacaauuaugacccaacugaagagauuccggcuccccuugggacaccugauuucguaggaaagauccaaggcguucugacccagacuacaaagggcgacgggagcacccgcggacacaaggccacgguguacaccgguucugcaccauuuacacccaaauugggcuccguccaguucucaacugacaccgaaaacgauuuugagacacaucagaauacuaaguucaccccugugggggucauccaagacggaagcacaacccaccgaaacgaaccacagcagugggugcuccccaguuacucuggcagaaauguucacaacgugcaucuggccccggcuguagcgccuacuuuuccaggugagcaauuacuguucuuuagguccacgaugcccggguguagcggcuauccuaauauggaucucgacugccuucugccccaggaguggguccagcacuucuaccaggaagcagccccagcucaaucggauguggccuugcuacgguuuguuaacccugacacaggacgugugcuguucgaguguaaacuccauaagucuggcuaugucaccguggcacacacugggcagcacgaucugguaauucccccaaacggauacuuucgcuucgacuccugggugaaucaguucuauacccuugccccgauggguaacggcacagggagaaggcgggcucuguga

SEQ ID NO: 18779 - RNA, 1623 nt, Artificial Sequence; identical to SEQ ID NO: 18712
  derived and/or modified sequence opt3 from VP1__Norovirus__BAJ13774

SEQ ID NO: 18780 - RNA, 1623 nt, Artificial Sequence
  derived and/or modified sequence opt3 from VP1__Norovirus__BAJ13777
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaugacguguucaccgucagcugcagaguucugacaaggcccaguccggauuuugacuucauuuuucucgugccucccaccguagaaucccggacuaaaccauucacagugccuaucuuaaccgucgaggaaaugacgaacucucgcuuucccauaccacuggagaaacuuuucacuggacccagcggugccuucgugguucagccucagaauggcagauguaccacagaugggguguugcugggaacuacccagcuauccccagucaacauuugcacauuuaggggcgacgugacccauaucgcagguucacggaauuacacgaugaaccucgcuagucugaauuggaacaauuaugauccgacugaggaaauucccgccccucuugggacaccagacuucguaggaaagauccaaggcguucugacccagacuacaaagggcgacgggagcacccgcggacacaaggcuacgguguacaccgguucugcccccuuuacaccuaaauugggcuccguccaguucucaacugauaccgagaacgacuuugaagcacaucagaauacaaaguucacuccagugggggucauccaagauggaagcaccacacaccgaaacgagccccagcagugggugcucccgaguuacucuggcagaaauguucaaaacgugcaccuggccccugcuguagcgccaaccuuucccggugaacaguuacuguucuuuagguccacuaugccuggguguagcggcuaucccaauauggaccucgauugccuucugccacaggaguggguccagcauuucuaccaagaggcagccccugcucagucggacguggccuugcuacgguuuguuaaccccgauacgggacgugugcuguucgaauguaaacuccacaagucuggcuaugucacaguggcacauaccgggcagcacgaccugguaauuccaccgaacggauacuuucgcuucgauuccugggugaaucaguucuauacucuugccccuauggguaacggcaccgggagaaggcgggcucuguga

SEQ ID NO: 18781 - RNA, 1623 nt, Artificial Sequence; identical to SEQ ID NO: 18712
  derived and/or modified sequence opt3 from VP1__Norovirus__BAJ13780

SEQ ID NO: 18782 - RNA, 1623 nt, Artificial Sequence; identical to SEQ ID NO: 18712
  derived and/or modified sequence opt3 from VP1__Norovirus__BAJ13783

SEQ ID NO: 18783 - RNA, 1623 nt, Artificial Sequence; identical to SEQ ID NO: 18261
  derived and/or modified sequence opt3 from VP1__Norovirus__BAJ13786

SEQ ID NO: 18784 - RNA, 1623 nt, Artificial Sequence
  derived and/or modified sequence opt3 from VP1__Norovirus__BAJ13792
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucgugcuagcaggaaaugccuuuacagcuggcaaaguaauuuucgccgcaguuccuccaaacuuuccgacugagggccucucccccucucaggugacgauguucccucauaucauugucgacgugcgccaacuggagccagugcuuaucccccugccugauguccgaaauaacuuuuaucacuacaaucagucgaacgacucaaccauaaaguugaucgcuaugcucuauacaccacugcgugccaacaaugcgggggaagauguuuucacugugagcugcagaguacugaccaggcccaguccggacuuugauuucauuuuucucgugccucccacagucgagucccggaccaaaccauucacugugccuaucuuaacaguugaagagaugaccaacucucgcuuucccauuccacuggagaaacuuuucacgggacccagcggugccuucgugguccagccucagaauggcagauguacuaccgacgggguguugcugggaacaacucaacuauccccaguaaacaucugcaccuuuaggggcgauguuacacauauagcagguucacggaauuacaccaugaaccucgcuagucugaauuggaacaauuaugacccgacggaagagauucccgccccucuugggacuccagauuucgugggaaagauccagggcguccugacacagaccacuaagggcgacgggagcacacgcggacacaaggcuaccguguacacggguucuacccccuuuacaccuaaauugggcuccguccaguucucaacugacaccgaaaacgauuuugagaaucaucaaaacacaaaguucacuccaguggggguuauucaggacggaggcaccacacaccgaaaugaaccccagcaaugggugcucccgagcuacagugguagaaacguacagaauguccaccuggccccugcaguggccccaaccuuucccggggagcaguuacuguucuuuaggucuacuaugccuggcuguuccggauaucccaacauggaucucgacugccuucugccacaggaguggguucaacauuucuaccaggaagcugcgccugcacagagcgauguggccuugcuacgguuugucaaccccgacacgggccgugugcuguucgaguguaaacuccacaagucgggguauguaacaguggcucauaccggacagcacgaucugguuaucccaccgaaugguuacuuucgcuucgacucuugggucaaccaauucuauacucuugccccuaugggcaaugggaccggaagaaggcgggcacuguga

SEQ ID NO: 18785 - RNA, 1623 nt, Artificial Sequence
  derived and/or modified sequence opt3 from VP1__Norovirus__BAJ13795
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagaucccuuggagugcuccacuuggacccgaucugaauccuuacuugagccacuuagcccggauguauaacggcuacgcggguggguucgaagugcaggucgugcuggcaggaaaugccuuuacagcuggcaaaguaauuuucgccgcaguuccaccgaacuuucccacugagggccuauccccuucucaggugacgauguucccacauaucauugucgacgugcgccaacucgagcccgugcugaucccucuuccagauguccgaaauaacuuuuaucacuacaaucagucgaacgacucaaccauaaagcugaucgcuauguuguauacaccccuccgugccaacaaugcgggggaagauguuuucacugugagcugcagaguacugaccaggccgaguccugacuuugauuucauuuuucuggugcccccaacagucgagucccggaccaaaccuuucacugugcccauccucacaguugaagagaugaccaacucucgcuuuccaauucccuuagagaagcuguucacgggaccuagcggugccuucgugguccagccacagaauggcagauguacuaccgacggggugcuuuugggaacaacucaacuguccccgguaaacaucugcaccuuuaggggcgauguuacacauauagcagguucacggaauuacaccaugaaccuagcuagucucaauuggaacaauuaugaccccacggaagagauuccugccccacuggggacucccgauuucgugggaaaaauccagggcguccuuacacagaccacuaagggcgacgggagcacacgcggacacaaggcuaccguguacacggguucuaccccuuuuacaccaaaacugggcuccguccaguucucaacugacaccgaaaacgauuuugagaaucaucaaaacacaaaguucacucccguggggguuauucaggacggaggcaccacacaccgaaaugaaccgcagcaauggguguugccuagcuacagugguagaaacguacagaauguccaccucgccccagcaguggcccccaccuuuccuggggagcagcuguuauucuuuaggucuacuaugcccggcuguuccggauauccaaacauggaucuggacugccuccuuccucaggaguggguucaacauuucuaccaggaagcugcgcccgcacagagcgauguggcccuguugcgguuugucaacccagacacgggccgugugcuauucgaguguaaacugcacaagucgggguauguaacaguggcucauaccggacagcacgaucucguuaucccgccuaaugguuacuuucgcuucgacucuugggucaaccaauucuauacucuggcccccaugggcaaugggaccggaagaaggcgggcacuuuga

SEQ ID NO: 18786 - RNA, 1623 nt, Artificial Sequence
  derived and/or modified sequence opt3 from VP1__Norovirus__BAJ13801
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucgugcuagcaggaaaugccuuuacagcuggcaaaauuaucuucgccgcaguaccuccaaacuuuccgacugagggccucucccccucucagguuacgauguucccucauauuaucguggacguccgccaacuggagccagugcuuauaccccugccugaugugcgaaauaacuuuuaucacuacaaucagucgaacgacucaaccaucaaguugauugcuaugcucuauacaccacugcgugccaacaaugcgggggaagaugucuucacuguuagcugcagagugcugaccaggcccaguccggacuuugauuucaucuuucucguaccucccacaguggagucccggaccaaaccauucacugucccuauuuuaacaguggaagagaugaccaacucucgcuuucccaucccacuggagaaacuuuucacgggacccagcggugccuucguugugcagccucagaauggcagauguacuaccgacggggucuugcugggaacaacucaacuauccccagugaacauaugcaccuuuaggggcgauguaacacauauugcagguucacggaauuacaccaugaaccucgcuagucugaauuggaacaauuaugacccgacggaagagauccccgccccucuugggacuccagauuucguuggaaagauucagggcgugcugacacagaccacuaagggcgacgggagcacacgcggacacaaggcuaccgucuacacggguucuacccccuuuacaccuaaauugggcuccgugcaguucucaacugacaccgaaaacgauuuugagaaucaucaaaacacaaaguucacuccagucggggugauccaggacggaggcaccacacaccgaaaugaaccccagcaauggguucucccgagcuacagugguagaaacgugcagaauguacaccuggccccugcagucgccccaaccuuucccggggagcaguuacuguucuuuaggucuacuaugccuggcuguuccggauaucccaacauggaucucgacugccuucugccacaggagugggugcaacauuucuaccaggaagcugcgccugcacagagcgauguugccuugcuacgguuugugaaccccgacacgggccguguccuguucgaguguaaacuccacaagucgggguaugugacaguagcucauaccggacagcacgaucuggugaucccaccgaaugguuacuuucgcuucgacucuuggguuaaccaauucuauacucuugccccuaugggcaaugggaccggaagaaggcgggcacuguga

SEQ ID NO: 18787 - RNA, 1623 nt, Artificial Sequence
  derived and/or modified sequence opt3 from VP1__Norovirus__BAJ13804
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguucagaacgugcaccuggccccugcaguagcuccaaccuuucccggugagcaguuacuguucuuuagguccacuaugccuggguguagcggcuaucccaauauggaucucgacugccuucugccacaggaguggguccaacauuucuaccaggaagcggccccugcacagucggauguggcuuugcuacgguuuguuaaccccgacacgggacgugugcuguucgaguguaaacuccacaagucuggcuaugucacaguggcccauaccgggcagcacgaucugguaauuccaccgaacggauacuuucgcuucgacuccugggugaaucaauucuauacucuugcaccuauggguaacggcaccgggagaaggcgggcccuguga

SEQ ID NO: 18788 - RNA, 1623 nt, Artificial Sequence; identical to SEQ ID NO: 18261
  derived and/or modified sequence opt3 from VP1__Norovirus__BAJ13807

SEQ ID NO: 18789 - RNA, 1623 nt, Artificial Sequence; identical to SEQ ID NO: 18787
  derived and/or modified sequence opt3 from VP1__Norovirus__BAJ13810

SEQ ID NO: 18790 - RNA, 1623 nt, Artificial Sequence; identical to SEQ ID NO: 18787
  derived and/or modified sequence opt3 from VP1__Norovirus__BAJ13816

SEQ ID NO: 18791 - RNA, 1623 nt, Artificial Sequence
  derived and/or modified sequence opt3 from VP1__Norovirus__BAJ13819
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugauccauauugcagguucacggaauuacacaaugaaccucgcugcccugaauuggaacaauuaugacccgaccgaagagauccccgcuccucuugggacgccagauuucguaggaaagauccagggcguucugacucagacaaccaagggcgacgggaguacucgcggacacaaggccacaguguacaccgguagcgcagacuuuacgcccaaauugggcucuguccaguucuccaccgauacagaaaacgacuuugagacucaucaaaauaccaaguucacaccugugggggucauucaggauggaucaacuacccaccgaaacgaaccacagcaaugggugcuccccagcuacaguggcagaaauguucacaacgugcaucuggccccggcuguagcgccuacauuuccaggugagcaguuacuguucuuuaggucuaccaugcccggguguuccggcuauccuaauauggaccucgauugccuucugccccaggaguggguccagcacuucuaccaagaagcagccccagcucagagcgacguggccuugcuacgguuuguuaacccugauacuggacgugugcuguucgaguguaaacuccauaagucgggcuaugucacgguggcacacacagggcagcacgaccugguaauacccccaaacggauacuuucgcuucgauucuugggugaaucaguucuauacccuugccccgauggguaacggcacugggagaaggcgggcucuguga

SEQ ID NO: 18792 - RNA, 1623 nt, Artificial Sequence; identical to SEQ ID NO: 18787
  derived and/or modified sequence opt3 from VP1__Norovirus__BAJ13822

SEQ ID NO: 18793 - RNA, 1623 nt, Artificial Sequence
  derived and/or modified sequence opt3 from VP1__Norovirus__BAJ13825
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucaccccucccacuguggagucccggacaaaaccauucaccguaccuaucuuaacgguggaagagaugacuaacucucgcuuucccauaccacuggagaaacuuuucaccggacccagcggugccuucgucgugcagccucagaauggcagauguacaacugacgggguuuugcugggaaccacacagcuauccccagugaacauuugcaccuuuaggggcgaugucacgcauaucgcagguucacggaauuacacuaugaaccucgcuagucugaauuggaacaauuaugacccgacagaagagauucccgccccucuugggaccccagauuucgugggaaagauccaaggcguacugacucagacaaccaagggcgacgggagcacgcgcggacacaaggcuaccguuuacacagguucugcccccuuuacuccuaaauugggcuccgugcaguucucaaccgacacagaaaacgauuuugaggcacaucagaauacuaaguucaccccagucggggugauccaagacggaagcacaacccaccgaaacgaaccccagcaguggguccucccgaguuacucuggcagaaaugugcaaaacguucaccuggccccugcuguggcgccaacuuuucccggugagcaguuacuguucuuuagguccacgaugccuggguguagcggcuaucccaauauggaucucgacugccuucugccacaggaguggguacagcauuucuaccaagaagcagccccugcucagucggauuuggcccuacugcgguuugucaaccccgacacaggacguguucucuucgaguguaaacugcacaagucuggcuaugugaccguggcacauacugggcagcacgaucuugucauuccaccgaacggauacuuucgcuucgacuccugggugaaucaguucuauacccuggccccuauggguaacggcacagggagaaggcgggcuuuguga

SEQ ID NO: 18794 - RNA, 1623 nt, Artificial Sequence
  derived and/or modified sequence opt3 from VP1__Norovirus__BAJ13828
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcauuccuuauauuucaggagcacuaugcccggguguucgggcuacccaaauauggaucuggacugccuccuuccucaggaguggguccagcacuuuuaucaggaagcggcacccgcccaaucugauguggcucuguugcgguucguuaacccagacacgggacgugugcuauuugaguguaaacugcauaaguccggcuacgucacaguggcccacaccgggcagcacgaucucguaauuccgccuaacggauauuuccgcuuugacucaugggugaaucaguucuacacucuggcacccauggguaacggcaccgggagaaggcgggcccuuuga

SEQ ID NO: 18795 - RNA, 1623 nt, Artificial Sequence; identical to SEQ ID NO: 18261
  derived and/or modified sequence opt3 from VP1__Norovirus__BAJ13831

SEQ ID NO: 18796 - RNA, 1623 nt, Artificial Sequence; identical to SEQ ID NO: 17982
  derived and/or modified sequence opt3 from VP1__Norovirus__BAJ13834

SEQ ID NO: 18797 - RNA, 1623 nt, Artificial Sequence; identical to SEQ ID NO: 18261
  derived and/or modified sequence opt3 from VP1__Norovirus__BAJ13837

SEQ ID NO: 18798 - RNA, 1623 nt, Artificial Sequence
  derived and/or modified sequence opt3 from VP1__Norovirus__BAJ13840
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcugcccugaacuggaauaacuaugacccgacggaagagauucccgcuccucuugggacuccagauuucguaggaaagauccagggcguucugacacagaccacuaaggccgacggcagcacacgcgggcacaaggcaaccguguacacgggaucugccgucuuuacccccaaauuggguuccgugcaguucucaacagacacugaaaaugauuuugagacccaucaaaacacaaaguucacuccugucggcgugauccaggacgggagcaccacacaccgaaaugaaccacagcaauggguucuccccaguuacucuggaagaaacgugcacaauguacaucuggcuccggcggucgcaccuaccuuuccaggcgagcaguuacuguucuuuagguccacuaugcccgguuguagcggguauccuaacauggaucucgacugccuucugccccaggagugggugcagcacuucuaccaagaagccgcuccagcccagucggauguugcauugcuacgguuugugaauccugacacgggccguguccuguucgaguguaaacuccauaagucuggauaugugacaguagcccacaccggccagcacgaucuggugauucccccaaacggguacuuucgcuucgacuccuggguuaaccaguucuauacucuugcuccgaugggaaaugguaccggcagaaggcgggcccuguga

SEQ ID NO: 18799 - RNA, 1623 nt, Artificial Sequence; identical to SEQ ID NO: 18261
  derived and/or modified sequence opt3 from VP1__Norovirus__BAJ13843

SEQ ID NO: 18800 - RNA, 1623 nt, Artificial Sequence; identical to SEQ ID NO: 18261
  derived and/or modified sequence opt3 from VP1__Norovirus__BAJ13846

SEQ ID NO: 18801 - RNA, 1623 nt, Artificial Sequence; identical to SEQ ID NO: 18261
  derived and/or modified sequence opt3 from VP1__Norovirus__BAJ13849

SEQ ID NO: 18802 - RNA, 1623 nt, Artificial Sequence
  derived and/or modified sequence opt3 from VP1__Norovirus__BAJ13852
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagccgggcuaugucacaguggcccauaccgggcagcacgaucugguaauuccuucuaacggauacuuucgcuucgacuccugggugaaucaguucuauacucuugcacccauggguaacggcaccgggagaaggcgggcccuguga

SEQ ID NO: 18803 - RNA, 1623 nt, Artificial Sequence
  derived and/or modified sequence opt3 from VP1__Norovirus__BAJ13855
augaagauggccagcaacgacgcuaaucccuccgauggcucugcagccaaccuggugccugaggucaauaacgaaguuauggcgcucgacccagugguaggggcugccaucgcagccccgguggcuggacagcaaaaugucauugaucccuggauaagaaacaauuucgugcaggcaccugguggcgaguuuaccguuucaccaaggaacgcccccggggaaauccuuuggagugcuccucugggaccagacuugaaucccuacuuaagccaccuggcccggauguauaacggcuacgcggguggguucgaggugcaggucauucuagcaggaaaugccuuuacagcuggcaaaaucauuuucgccgcagugccuccaaacuuuccgacugaaggccucucccccucucagguaacgauguucccucauaucauaguugaugugcgccaacuggagccaguccuuaucccccugccugacgugcgaaauaacuuuuaucacuacaaucagucgaacgauucaaccauuaaguugaucgcuaugcucuauacaccacugcgugccaacaaugcgggggaggacguguucacugucagcugcagaguucugaccaggcccaguccggauuuugacuucauuugucucgugccucccacaguagaaucccggaccaaaccauuuacugugccuaucuuaacagucgaggaaaugaccaacucucgcuuccccauaccacuggagaaacuuuuuacgggacccagcuccgccuucgugguucagccucagaaugguagaugcacuaccgauggcguguugcuggggacaacucaacuaucaccagucaacauuuguaccuucaggggagacgugacacauaucgcaggcagucggaauuacaccaugaaccucgcuagccugaauuggaacaauuaugauccgacggaggaaauucccgccccucuugguacuccagacuuuguagggaagauccagggaguucugacacagaccacuaagggcgacggcucuacacgcgggcacaaggcuaccguguacacgggauccgcccccuucaccccuaaauuggguucaguccaguuuagcacagauacugagaacgacuucgaaacccaucaaaauacaaaguuuacuccagugggcgucauccaggaugggggaaccacacaccgaaacgagccccagcaaugggugcucccgaguuacucuggcagaaauguuccuaacgugcaccuggcaccagccguagcucccaccuucccuggugaacaguuacuguuuuucagguccacuaugcccgggugcagcggcuauccaaauauggaccucgauugucuucugccucaggaguggguccagcauuuuuaccaagaggcggcacccgcccagucggacguggcuuugcuacgguucguuaacccagauacgggacgugugcuguuugaaugcaaacuccacaagucuggcuaugucacaguggcccauaccgggcagcacgaccugguaauuccgccuaacggauacuuccgcuuugauuccugggugaaucaguucuauacucuugcacccauggguaacggcaccgggagaaggcgggcccuguga

SEQ ID NO: 18804 - RNA, 1623 nt, Artificial Sequence; identical to SEQ ID NO: 18125
  derived and/or modified sequence opt3 from VP1__Norovirus__BAJ13858

SEQ ID NO: 18805 - RNA, 1623 nt, Artificial Sequence
  derived and/or modified sequence opt3 from VP1__Norovirus__BAJ13861
augaagaugagaagcuccgacgccaaccccucugauggcucaaccgcuaaucuggugccugaggucaacaaugaaguuauggcacucgagccagugguaggggccgcgaucgcugccccgguggcaggacagcaaaacgucaucgaccccuggauaaggaauaacuucgugcaggccccugguggcgaauuuacaguuaguccacggaaugcucccggggagauccuuuggagcgcaccucugggaccagauuugaaccccuacuuaucccaccuggcccgcauguauaauggcuacgcugguggguucgaagugcaggucauucuagccggaaacgcguuuacugcaggcaaaaucauuuucgccgcugugccuccaaauuuuccgacggagggccucucucccucgcagguaaccauguucccucauaucauaguugacgugcgacaacuggagccaguccuuaucccccugccugaugugcguaacaauuuuuaucacuacaaccagucaaaugacccaacaauuaaguugaucgccaugcucuauacuccccugagagcaaacaacgcuggggaugacguguucaccggaagcugcaggguccugacacggccgaguccugauuuugacuucauuuuucucguucccccaaccguggaaucccgcacuaaaccuuucucuguauccuuuuucacaggugaggaaaugaccaauuccagauuccccaucccauuagagaagcuguuuacgggccccucaagugccuucgugguccagccucagaacgggagguguacuaccgauggagugcuuuugggcacaacucaacugagcccaguuaauauaugcaccuuucggggugacgugacacauauuaccgggucucgcaacuacacgaugaaucuagcgacucagaacuggaauagcuaugauccgacagaggaaauccccgccccucucggaaccccagacuucgucggcaaaauucagggcgugcugacucagacaacccgagcagacgggucaacgagaggacacaaggcuaccguauacacagguagcgccgauuuugcucccaaacuuggcaggguucaauucgccacugacaccgauaacgacuuugaugcaaaucagaacacaaaguucacuccugugggggucauccaggacggagauaccgcccaucggaaugagccacaacagugggugcugcccaguuacucuggccguaacucccacaauguccacuuggcuccggcgguggcaccuacauuuccaggugaacagcuccuguucuuucgcagcaccaugcccggguguucgggcuauccuaacauggacuuagauugccugcucccccaggaguggguucaauacuucuaucaggaagccgcuccagcccagucugacguggcacuucugagauuuguaaauccugauacuggaagggucuuguucgaguguaagcuacauaaauccggcuacgugacgguugcccacacagggcagcaugaccuggugauucccccaaacggauauuuccgguuugacucaugggucaaccaauucuacacccucgcuccgauggguaauggcacugggcgacgcagagcccuguga

SEQ ID NO: 18806 - RNA, 1623 nt, Artificial Sequence; identical to SEQ ID NO: 18125
  derived and/or modified sequence opt3 from VP1__Norovirus__BAJ13864

SEQ ID NO: 18807 - RNA, 1623 nt, Artificial Sequence
  derived and/or modified sequence opt3 from VP1__Norovirus__BAJ13867
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuguauucucgauuuacccccaaccguggaaucccggacuaaaccuuucucuguacccauccugacaguggaggaaaugaccaauagccgcuuuccaauaccccuugagaaguuguucacgggaccuuccucagcguuugucgugcagccacagaacgguagaugcacuaccgacggcguucugcuagggacaacucaacucaguccggugaauauuuguaccuucaggggagaugucacacauaucaccggcagccggaacuacacgaugaaucuggccacucagaacuggaacucuuaugaccccacagaggaaauuccugcaccacuugguacccccgacuucguggggaaaauccagggaguacugacucagacaacccgcgcugauggcuccacgcgaggccacaaggccaccguuuacacagggucagcugacuuugccccuaaguugggaagagugcaauucgcaacugauaccgacaaugauuuugacgccaaucagaacacaaaauucacuccagucggugugauccaggauggcgacaccgcucauaggaaugagccccaacaguggguccucccgagcuacagugggcggaacucucacaaugugcaccuggcgccugcaguugccccaacauuucccggagaacaguuacuguucuuucguuccaccaugccuggcugcagcgguuaucccaacauggaucucgacugucuucugccacaggagugggugcaauacuucuaucaggaagcugccccugcacagucggauguagccuugcuacgcuuugucaaucccgacacugggagagugcuguucgagugcaagcuccauaaaucuggcuacguuacgguggcucacacaggacagcaugaccuggucauuccaccgaacggcuauuuuagguucgauuccugggugaaccaauuuuacacccuugccccuauggggaauggaacuggucggcgacgcgcacuguga

SEQ ID NO: 18808 - RNA, 1623 nt, Artificial Sequence
  derived and/or modified sequence opt3 from VP1__Norovirus__BAJ13873
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaaguggucuucacuguuaguugcagagugcugaccaggcccuccccggauuuugacuucauuugucucguaccucccacaguggagucucggaccaaaccauuuacugucccuaucuuaacaguggaagagaugaccaauagccgcuuccccauaccacuggagaaacuuuuuacgggacccuccucagccuucguugugcagccucagaacgguagaugcacuaccgauggcgucuugcuggggacaacucaacuaaguccagugaauauuuguaccuucaggggagacguaacacauaucgcaggcagccggaacuacaccaugaaucucgcuucucugaacuggaauaacuaugauccgacggaagagauucccgccccucuugguacuccagacuuuguugggaagauccagggagugcugacacagaccacuaagggcgauggcuccacacgcgggcacaaggcuaccgucuacacgggaucagcccccuucaccccuaaauuggguagcgugcaguuuaguacagacacugaaaaugacuucgagacccaucaaaacacaaaguuuacuccagucggcgugauccaggaugggggaaccacacaccgaaaugaaccccagcaauggguucucccgucuuacuccggcagaaacgugccuaauguacaccuggcaccagccgucgcucccaccuucccuggugagcaguuacuguuuuucaggagcacuaugcccgggugcucgggcuauccaaacauggaccucgauugucuucugccucaggagugggugcagcauuuuuaccaagaagcggcacccgcccagucugacguugcuuugcuacgguucgugaauccagauacgggacguguccuguuugagugcaaacuccacaagccgggcuaugugacaguagcccauaccgggcagcacgaccuggugauuccuuccaacggauacuuccgcuuugauucauggguuaaccaguucuauacucuugcacccauggguaauggcaccgggagaaggcgggcccuguga

SEQ ID NO: 18809 - RNA, 1623 nt, Artificial Sequence
  derived and/or modified sequence opt3 from VP1__Norovirus__BAJ13876
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcugcccugaauuggaacaauuaugacccgacggaagagauucccgcuccucuugggacuccagauuucguaggaaagauccagggcguucugacacagaccacuaagggcgacgggaguacacgcggacacaaggccaccguguacacggguagcgcagacuuuacccccaaauugggcucuguccaguucuccacagauacugaaaacgacuuugagacccaucaaaauacaaaguucacuccugugggggucauccaggauggaucaaccacacaccgaaacgaaccacagcaaugggugcuccccagcuacaguggcagaaauguucacaacgugcaucuggccccggcuguagcgccuaccuuuccaggugagcaguuacuguucuuuaggucuacuaugcccggguguuccggcuauccuaauauggaccucgauugccuucugccccaggaguggguccagcacuucuaccaagaagcagccccagcucagagcgacguggccuugcuacgguuuguuaacccugauacgggacgugugcuguucgaguguaaacuccauaagucgggcuaugucacaguggcacacaccgggcagcacgaccugguaauucccccaaacggauacuuucgcuucgauucuugggugaaucaguucuauacucuugccccgauggguaacggcaccgggagaaggcgggcucuguga

SEQ ID NO: 18810 - RNA, 1623 nt, Artificial Sequence
  derived and/or modified sequence opt3 from VP1__Norovirus__BAJ13879
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccauggaccucgcuagccugaacuggaauaacuaugauccgacggaagagauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccaguucagcacagauacugaaaaugacuuugagacccaucaaaacacaaaguucacuccagugggcgucauccaggaugggggaaccacacaccgaaaugaaccccagcaaugggugcucccgaguuacucuggcagaaacguuccuaaugugcaccuggcaccagccguagcucccaccuuuccuggugagcaguuacuguucuuuagguccacuaugcccggguguagcggcuauccaaacauggaccucgauugccuucugccucaggaguggguccagcauuucuaccaagaagcggcacccgcccagucggacguggcuuugcuacgguuuguuaauccagauacgggacgugugcuguucgaguguaaacuccacaagucuggcuaugucacaguggcccauaccgggcagcacgaccugguaauuccgccuaacggauacuuucgcuucgauuccugggugaaccaguucuauacucuugcacccauggguaauggcaccgggagaaggcgggcccuguga

SEQ ID NO: 18811 - RNA, 1623 nt, Artificial Sequence; identical to SEQ ID NO: 17982
  derived and/or modified sequence opt3 from VP1__Norovirus__BAJ13882

SEQ ID NO: 18812 - RNA, 1623 nt, Artificial Sequence
  derived and/or modified sequence opt3 from VP1__Norovirus__BAJ13885
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgauaaugacuuugaugccaaucagaacacaaaauucacuccagugggugucauccaggacggcaauaccgcucauaggaacgagccccaacaguggguguugccgagcuacagugggcguaauucucacaacguucaccucgcgccugcaguggccccaacauuucccggagaacagcuguuauucuuucgguccaccaugccuggcuguagcgguuaucccaauauggaucuggacugccuccuuccacaggaguggguacaauacuucuaucaggaagcugccccugcacagucggaugucgcccuguugcgcuuugugaaccccgacacugggagaguucuauucgaguguaagcugcauaaaucuggcuacgugacggucgcucacacaggacagcaugaucucgugauuccaccgaacggcuauuuuagguucgacuccuggguaaaucaauucuacacccuggccccuauggggaacggaacuggucggcgacgcgcacuuuga

SEQ ID NO: 18813 - RNA, 1623 nt, Artificial Sequence
  derived and/or modified sequence opt3 from VP1__Norovirus__BAJ13891
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagcgucccggacuaaaccuuucucugugcccagcgucacaguggaagagaugaccaauucccgcuuuccaauccccuuagaaaagcuguucacgggaccuucaagugccuucguugugcagccacagaacgguagauguacuaccgauggcguccuuuuggggacaacucaacugagcccggugaauauaugcaccuuuaggggagacguaacacauauuaccggcucucggaacuacacgaugaaucuagcaacucagaacuggaacuccuaugaucccacagaggagaucccugcuccacucgguacccccgacuucguugggaaaauucagggagugcugacucagacaacccgcgccgacggcucaacgcgaggccacaaggcuaccgucuacacagggagcgccgauuuugcaccuaaacuuggaagagugcaauucgccacugacaccgauaaugacuuugaugcuaaucagaacacaaaguucacuccagucggugugauccaggacggcgauaccgcgcauaggaaugaaccccaacaguggguucugccgaguuacucugggcggaacucccacaaugugcacuuggcaccuacaguagccccaaccuuucccggagagcagcuccuguucuuucguagcacuaugccuggcuguucggguuaucccaacauggacuuagauugccugcucccacaggaauggguccaauacuucuaucaggaggcugccccugcacagucugacguggcccuucugcgcuuuguuaaucccgauacggggagaguguuguucgaauguaagcuacauaaauccggcuacgucacaguggcucacaccggacagcaugaccugguaaucccaccgaacggcuauuuuagguucgacucaugggugaaccaauucuacacucucgccccuauggggaauggaaccggucggcgacgcgcacuguga

SEQ ID NO: 18814 - RNA, 1623 nt, Artificial Sequence
  derived and/or modified sequence opt3 from VP1__Norovirus__BAJ13894
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccacagaacgcacccagugagauccuuuggagcgccccucuggggccagauuugaaucccuacuuaucccaccuggcuaggauguauaacggauacgccggcgguuucgaagugcaggucauucuagcggggaaugcauuuacugccggaaaaaucauuuucgcugccgugccuccaaacuuuccgacggagggccucucucccucgcaaguaaccauguucccucauaucauaguugacgugcggcagcuggagccaguccuuaucccccugccugaugugcgcaauaacuuuuaucacuacaaucagucaaacgacccaacaauuaaguugaucgcaaugcucuauacuccccugcgagcuaacaaugccggcgaugacguguucaccgucagcugccguguucugacaagaccgaguccugauuuugacuucauuuuucucgugcccccaaccguagaauccaggacuaaaccuuucacagugcccaucuuaaccgucgaggaaaugacgaacucucgguuuccaauaccccuggagcgccuuuacacugggccuagcuccgcguucgugguucagccacaaaauggaagauguaccacagaugguguguugcugggcacuacccagcuaucagccgucaacauuugcacauucaggggagacgugacccauaucgcagggagucggaauuauacgaugaaccucgcuagccagaauuggaacaauuacgauccgacugaggaaauucccgccccucugggcacaccagacuuuguagguaagauccaggggaugcuuacccaaacuacacgcucugacggauccacccgaggccacaaagcuacgguucugaccggcucagccgauuucgcacccaaguuggggagagugcaguuugccacagacacugauaacgacuucgagagcggacagaauaccaaguuuacaccugucggugugauccaagauggcaguacuacccauaggaacgaaccacagcaguggguccuccccaauuacucugggcggacaggacacaacgugcaccuggcuccggcgguugcaccuaccuauccaggcgagcaguuacuguucuuucguuccacuaugcccgguuguagcggguacccuaauauggaccucgauugccuucugccccaagaaugggugcagcauuucuaucaggaggccgcuccagcccagucggacguagcauugcuacgcuuugucaacccugauacgggcagagugcuguucgaguguaaacuccacaagucuggauacguuacaguggcccauaccggccaacacgaccuggucauucccccaaacggguauuuuagguucgauuccugggugaaucaguuuuacacucuugcuccgaugggaaacgguaccggccggcgacgcgccguauga

SEQ ID NO: 18815 - RNA, 1623 nt, Artificial Sequence
  derived and/or modified sequence opt3 from VP1__Norovirus__BAJ13897
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgauaaugacuuugaugccaaucagaacacaaaauucacuccagugggugucauccaggacggcgauaccgcucauaggaaugagccccaacaguggguguugccgagcuacagugggcggaacucucacaauguucaccucgcgccuacaguggcaccaaccuuucccggagaacagcuguuauucuuucguuccacuaugccuggcuguagcgguuaucccaacauggaccuggauugccuccuuccacaggaguggguacaauacuucuaucaggaagccgcuccugcccagucggacgucgcacuguugcgcuuugugaaucccgauacggggagaguucuauucgaguguaagcugcauaaaucuggcuacgugacagucgcccacaccggacagcaugaccucgugauuccaccgaacggcuauuuuagguucgacuccuggguaaaccaauucuacacucuggcuccuauggggaauggaaccggucggcgacgcgcccuuuga

SEQ ID NO: 18816 - RNA, 1623 nt, Artificial Sequence
  derived and/or modified sequence opt3 from VP1__Norovirus__BAJ13900
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggaacaauuacgauccgacugaggaaauucccgccccucuggguacaccagacuuuguagggaagauccagggaaugcuuacccagacuacacgaagcgacggcucuaccagaggccacaaagcuacgguucugaccggguccgccgauuucgcacccaaguugggaagggugcaauuugccacagacacugauaacgacuucgagucaggucagaauaccaaguuuacaccugucggcgugauccaggaugggagcacuacccaucggaacgaaccacaacaguggguccuccccaauuacaguggacguacaggccacaacgugcaccuggcuccggcgguugcaccuaccuauccaggugagcaguuacuguucuuucgcucuacuaugcccggguguuccggcuacccuaauauggaccucgauugccuucugccccaggaaugggugcaacauuucuaucaggaggccgcuccagcccagagcgacguagcauugcuaagauuugucaacccugauacgggaagggugcuguucgaguguaaacuccacaagucgggcuacguuacaguggcccauaccgggcagcacgaccuggucauucccccaaacggauauuuucgguucgauucuugggugaaucaauuuuacacucuugcuccgauggguaacggcaccgggcgacgcagagccguauga

SEQ ID NO: 18817 - RNA, 1623 nt, Artificial Sequence; identical to SEQ ID NO: 18809
  derived and/or modified sequence opt3 from VP1__Norovirus__BAJ13903

SEQ ID NO: 18818 - RNA, 1623 nt, Artificial Sequence; identical to SEQ ID NO: 18816
  derived and/or modified sequence opt3 from VP1__Norovirus__BAJ13906

SEQ ID NO: 18819 - RNA, 1623 nt, Artificial Sequence
  derived and/or modified sequence opt3 from VP1__Norovirus__BAJ13909
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucaccggcagucggaauuacacgaugaaccucgcaagccugaauuggaacaauuaugauccgacugaggaaauucccgcuccucuugguacaccagacuucguagggaagauccagggaguucugacccagacuacaaagggcgacggcucuacccgcgggcacaaggccacgguguacaccggauccgcugauuuuacacccaaauuggguucaguccaguucgccacugacaccgagaacgauuuugaaacacaucaaaauacuaaguucaccccugugggcgucauccaggacgggggaacaacccaccgaaacgagccacagcaaugggugcuccccagcuacaguggcagaaauguucacaacgugcaucuggcaccggccguagcuccuaauuuuccaggugaacaguuacuguucuuuaggucuacuaugcccggguguuccggcuauccuaacauggaucucgacugccuucugccccaggaguggguccagcacuucuaccaagaggcggcaccagcccagagcgauguggcuuugcuacgguuuguuaacccugacacgggacgugugcuguucgaauguaaacuccauaagucgggcuaugucacaguggcccacaccgggcagcacgaucugguaauucccccaaauggauacuuucgcuucgacucuugggugaaccaguucuauacucuugcaccgauggguaauggcaccgggagaaggcgggcccuguga

SEQ ID NO: 18820 - RNA, 1623 nt, Artificial Sequence; identical to SEQ ID NO: 17982
  derived and/or modified sequence opt3 from VP1__Norovirus__BAJ13912

SEQ ID NO: 18821 - RNA, 1623 nt, Artificial Sequence; identical to SEQ ID NO: 18747
  derived and/or modified sequence opt3 from VP1__Norovirus__BAJ13918

SEQ ID NO: 18822 - RNA, 1623 nt, Artificial Sequence
  derived and/or modified sequence opt3 from VP1__Norovirus__BAJ13924
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguucagaaugugcaccuggccccugcaguagcuccaaccuuucccggugagcaguuacuguucuuuaggagcacuaugccuggguguucgggcuaucccaacauggaucucgacugccuucugccacaggaguggguccaacauuucuaccaggaagcggccccugcacagucugauguggcuuugcuacgguuuguuaaucccgacacgggacgugugcuguucgaguguaaacuccacaaguccggcuaugucacaguggcccauaccgggcagcacgaucugguaauuccaccgaacggauacuuucgcuucgacucaugggugaaccaauucuauacucuugcaccuauggguaauggcaccgggagaaggcgggcccuguga

SEQ ID NO: 18823 - RNA, 1623 nt, Artificial Sequence
  derived and/or modified sequence opt3 from VP1__Norovirus__BAJ13927
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacggaauuacacgaugaaccucgcuagucugaauuggaacaauuaugacccgacugaagagauucccgccccucuugggacaccagauuucguaggaaagauccaaggcguucugacccagacuacaaagggcgacgggagcacccgcggacacaaggcuacgguguacaccgguggcgcccccuuuacaccuaaauuggggucugcacaguucuccacugacaccgaaaacgauuuugagacacaucagaauacuaaguucaccccagucggagugauccaagacggcgguacaacccaccgaaacgaaccccagcaguggguccucccgucauacagcgggagaaaugugcacaacguucaucuggccccugcuguggcgccaacuuuucccggcgagcaauuacuguucuuuaggaguacgaugccuggauguucuggcuaucccaauauggaucucgacugccuucugccacaggaguggguacagcacuucuaccaggaagcagccccugcucaauccgaugucgccuugcuacgguuugugaaccccgacacagggcguguucuguucgaguguaaacuccauaagagcggauaugugaccgucgcacacacuggucagcacgaucuggugauuccaccgaacggcuacuuucgcuucgacucguggguaaaucaguucuauacccuugccccuauggggaacggaacaggcagaaggcgggcucuguga

SEQ ID NO: 18824 - RNA, 1623 nt, Artificial Sequence
  derived and/or modified sequence opt3 from VP1__Norovirus__BAJ13930
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucuggauccagacuugaaucccuacuuaagccagcuggcccggauguauaacggauacgcgggcgguuucgaagugcaggucauucuagcagggaaugccuuuacagcuggaaaaaucauuuucgccgcagugccuccaaacuuuccgacugagggccucucccccucucaaguaacgauguucccucacaucauaguugaugugcgccagcuggagccaguccuuaucccccugccugacgugcgaaauaacuuuuaucauuacaaucagucgaacgauucaaccauuaaguugaucgcuaugcucuauacaccacugcgugccaacaaugcgggcgaagacguguucacugucagcugcagaguucugaccaggcccaguccggauuuugacuucauuuuucucgugccucccacaguagagucccggaccaaaccauucacugugccuaucuuaacagucgaagagaugaccaacucucgcuuucccauaccacuggagaaacuuuucacggggcccagcuccgccuucgugguucagccucaaaauggaagauguacuaccgaugguguguugcugggcacaacucagcuaucaccagucaacauuugcaccuuuaggggagacgugacacacaucgcagggagucggaauuacaccaugaaccucgcuagccugaauuggaacaauuaugauccgacggaagagauucccgccccucuuggcacuccagacuucguagguaagauccaggggguucugacacagaccacuaagggagacggcucuacacgcggccauaaggcuaccguguacacgggguccgcccccuuuaccccuaaauugggaucaguccaauucagcacagauacugaaaacgacuuugagacccaccagaauacaaaguucacuccagugggugucauccaggauggcgggaccacacaucgaaacgaaccccaacagugggugcucccgaguuacucuggaagaaauguuccuaacgugcaccuggcaccagccguagcucccaccuuuccuggcgagcaguuacuguucuuuagguccacuaugcccgguuguagcggguauccaaauauggaccucgauugccuucugccucaggaguggguccaacacuucuaccaggaagcggcacccgcccagucggacguggcuuugcuacgguuuguuaacccagauacgggccgugugcuguucgaguguaaacuccauaagucuggauaugucacaguggcccacaccggccagcaugaccugguaauuccgccuaacggguacuuucgcuucgauuccugggugaaucaauucuauacucuugcacccaugggaaacgguaccggcagaaggcgggcccuguga

SEQ ID NO: 18825 - RNA, 1623 nt, Artificial Sequence; identical to SEQ ID NO: 18125
  derived and/or modified sequence opt3 from VP1__Norovirus__BAJ13933

SEQ ID NO: 18826 - RNA, 1623 nt, Artificial Sequence; identical to SEQ ID NO: 17982
  derived and/or modified sequence opt3 from VP1__Norovirus__BAJ13936

SEQ ID NO: 18827 - RNA, 1623 nt, Artificial Sequence; identical to SEQ ID NO: 18261
  derived and/or modified sequence opt3 from VP1__Norovirus__BAJ13939

SEQ ID NO: 18828 - RNA, 1623 nt, Artificial Sequence
  derived and/or modified sequence opt3 from VP1__Norovirus__BAJ13942
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacgggacuacacgaugaaucucgcuagucugaacuggaauaacuaugauccgacugaagagauucccgccccucuugggacaccagacuucguaggaaagauccaaggcguucugacccagacuacaaagggcgacgggagcacccgcggacacaaggcuacgguguacaccgguucugcccccuuuacaccuaaauugggcuccguccaguucucaacugauaccgaaaaugacuuugagacacaucagaacacuaaguucaccccagugggggucauccaagauggaggcacaacccaccgaaaugaaccccagcagugggugcucccgagcuacagugguagaaacguucacaaugugcaucuggccccugcaguagcuccaacuuuucccggggagcaauuacuguucuuuaggucuacgaugccuggcuguuccggauaucccaacauggaccucgauugccuucugccacaggaguggguccagcacuucuaccaggaagcggccccugcacaaagcgacguggcuuugcuacgguuuguuaaucccgauacaggccgugugcuguucgaguguaaacuccauaagucgggguaugucaccguggcccacacuggacagcacgaccugguaauuccaccgaacgguuacuuucgcuucgauucuugggugaaccaguucuauacccuugcaccuaugggcaaugggacaggaagaaggcgggcccuguga

SEQ ID NO: 18829 - RNA, 1623 nt, Artificial Sequence; identical to SEQ ID NO: 18787
  derived and/or modified sequence opt3 from VP1__Norovirus__BAJ13945

SEQ ID NO: 18830 - RNA, 1623 nt, Artificial Sequence
  derived and/or modified sequence opt3 from VP1__Norovirus__BAJ13948
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaacaccacacaccgaaaugaaccccagcaaugggugcucccgaguuacucuggaagaaacguucagaaugugcaccuggccccugcaguagcuccaaccuuucccggcgagcaguuacuguucuuuagguccacuaugccugguuguagcggguaucccaacauggaucucgacugccuucugccacaggaguggguccaacauuucuaccaggaagcggccccugcacagucggauguggcuuugcuacgguuuguuaaccccgacacgggccgugugcuguucgaguguaaacuccacaagucuggauaugucacaguggcccauaccggccagcacgaucugguaauuccaccgaauggguacuuucgcuucgacuccugggugaaccaauucuauacucuugcaccuaugggaaaugguaccggcagaaggcgggcccuguga

SEQ ID NO: 18831 - RNA, 1623 nt, Artificial Sequence; identical to SEQ ID NO: 18125
  derived and/or modified sequence opt3 from VP1__Norovirus__BAJ13951

SEQ ID NO: 18832 - RNA, 1623 nt, Artificial Sequence
  derived and/or modified sequence opt3 from VP1__Norovirus__BAJ13954
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggaacaccacacaccgaaaugaaccccagcaauggguccucccgaguuacucuggaagaaacgugcagaauguucaccuggccccugcaguggcuccaaccuuucccggcgagcaguuacuguucuuuagguccacuaugccugguuguagcggguaucccaacauggaucucgacugccuucugccacaggaguggguacaacauuucuaccaggaagcggccccugcacagucggaugucgcuuugcuacgguuugugaaccccgacacgggccguguucuguucgaguguaaacuccacaagucuggauaugugacagucgcccauaccggccagcacgaucuggugauuccaccgaauggguacuuucgcuucgacuccuggguaaaccaauucuauacucuugcaccuaugggaaaugguaccggcagaaggcgggcccuguga

SEQ ID NO: 18833 - RNA, 1623 nt, Artificial Sequence
  derived and/or modified sequence opt3 from VP1__Norovirus__BAJ13957
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccuagcggaccagaucugaaucccuacuugucccacuuagcccggauguucaacgacuaugcgggcgguuuugaagugcaggucauucuggcagggaaugccuucacugcuggaaaaaucauuuuugccgcagugccuccaaacuucccgacggagggccuaucucccucgcagguaaccauguuuccucauaucauaguugaugugcgccagcucgagccaguccugaucccccuuccugacgugcgaaauaacuucuaccacuauaaucaaucaaacgauagcacaauuaagcugaucgcuauguuguacacuccacuccgugccaacaaugcgggcgaagacguguuuaccgucaguugcagaguucugacaaggcccuccccggauuucgacuuuauuuuccuggugccucccaccguagagucucggacuaaaccauuuacagugccuauccucaccgucgaagagaugacgaacagccgcuuccccauaccauuagagaagcuguucacugggcccuccggagccuuugugguucagccucagaaugguagauguaccacagauggcgugcuuuuggggacuacccagcugucaccagucaacauuugcacauucaggggagacgugacccauaucgcaggcagucggaauuauacgaugaaccuagcuagccucaauuggaacaauuacgauccgacugaagagauucccgccccucuggguacaccagacuuuguagggaaaauccaaggaguucuuacccagacuacaaagggcgacggcucuacccgcgggcacaaggcuacgguguauaccggauccgcccccuucacaccuaaacuggguucaguccaguuuagcacugauaccgaaaacgacuucgaggcacaucagaauacaaaguuuacuccagugggcgucauccaagaugggaguaccacacaccgaaacgaaccccagcaguggguguugccgucuuacuccggaagaaauguucaaaacgugcaccucgccccugcuguagcgccaaccuuccccggcgagcagcuguuauuuuucaggagcacuaugccugguuguucgggguaccccaauauggaccuggauugccuccuuccacaggaguggguccagcauuuuuaucaagaagcagccccugcucagucugacguggcccuguugcgguucguuaaccccgauacgggccgugugcuauuugaguguaaacugcacaaguccggauacgucacaguggcacauaccggccagcacgaccucguaauuccaccgaacggguauuuccgcuucgauucaugggugaaucaguuuuacacucuggccccuaugggaaacgguaccggcagaaggcgggcucuuuga

SEQ ID NO: 18834 - RNA, 1623 nt, Artificial Sequence; identical to SEQ ID NO: 18261
  derived and/or modified sequence opt3 from VP1__Norovirus__BAJ13960

SEQ ID NO: 18835 - RNA, 1623 nt, Artificial Sequence; identical to SEQ ID NO: 18261
  derived and/or modified sequence opt3 from VP1__Norovirus__BAJ13963

SEQ ID NO: 18836 - RNA, 1623 nt, Artificial Sequence; identical to SEQ ID NO: 18747
  derived and/or modified sequence opt3 from VP1__Norovirus__BAJ13966

SEQ ID NO: 18837 - RNA, 1623 nt, Artificial Sequence; identical to SEQ ID NO: 17982
  derived and/or modified sequence opt3 from VP1__Norovirus__BAJ13969

SEQ ID NO: 18838 - RNA, 1623 nt, Artificial Sequence
  derived and/or modified sequence opt3 from VP1__Norovirus__BAJ13972
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacgggacuacaccaugaaucucgcuagucugaacuggaauaacuaugauccgacggaagagauucccgccccucuugggacuccagacuucguaggaaagauccagggcguucugacacagaccacuaagggcgacgggagcacacgcggacacaaggcuaccguguacacggguucuguccccuuuaccccuaaauugggcuccgugcaguucucaacagauacugaaaaugacuuugagacccaucaaaacacaaaguucacuccagucggggugauccaggauggaagcaccacacaccgaaaugaaccccagcaauggguucucccgaguuacucuggcagaaacgugcacaauguacaucuggccccugcagucgccccaaccuuucccggugagcaguuacuguucuuuagguccacuaugccuggguguagcggcuaucccaacauggaccucgauugccuucugccacaggagugggugcagcacuucuaccaagaagcugcgccugcacagucggacguugccuugcuacgguuugugaaucccgauacgggacguguccuguucgaguguaaacuccauaagucuggcuaugugacaguagcucacaccgggcagcacgaccuggugauuccaccgaacggauacuuucgcuucgauuccuggguuaaccaguucuauacucuugccccuauggguaauggcaccgggagaaggcgggcacuguga

SEQ ID NO: 18839 - RNA, 1623 nt, Artificial Sequence
  derived and/or modified sequence opt3 from VP1__Norovirus__BAJ13975
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgccgauuuuacccccaaauuggguucaguccaguucgcaacagacacugagaacgauuuugaaacccaucaaaauacaaaguucacuccugugggcgucauccaggacgggggaaccacacaccgaaacgagccacagcaaugggugcuccccagcuacaguggcagaaauguucacaacgugcaucuggccccggcuguagcgccuaauuuuccaggugaacaguuacuguucuuuaggucuaccaugcccggguguuccggcuauccuaacauggaucucgacugccuucugccccaggaguggguccagcacuucuaccaagaggcagccccagcucagagcgauguggccuugcuacgguuuguuaacccugacacuggacgugugcuguucgaauguaaacuccauaagucgggcuaugucacgguggcacacacagggcagcacgaucugguaauucccccaaauggauacuuucgcuucgacucuugggugaaccaguucuauacccuugccccgauggguaauggcacugggagaaggcgggcucuguga

SEQ ID NO: 18840 - RNA, 1623 nt, Artificial Sequence
  derived and/or modified sequence opt3 from VP1__Norovirus__BAJ13978
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucuacccccuuuacaccuaaauugggcuccguccaguucucaacugacaccgaaaacgauuuugagacacaucaaaauacuaaguucaccccagugggggucauccaggacggaagcacaauucaccgaaacgaaccccagcaaugggugcucccgaguuacucuggcagaaauguucagaacgugcaccuggccccugcaguagccccaaccuuucccggugagcaguuacuguucuuuagguccacuaugccuggguguagcggcuaucccaauauggaucucgacugccuucugccacaggaguggguccaacauuucuaccaggaagcugcgccugcacagucggauguggccuugcuacgguuuguuaaccccgacacgggacgugugcuguucgaguguaaacuccacaagucuggcuaugucacaguggcucauaccgggcagcacgaucugguaauaccaccgaacggauacuuucgcuucgacuccugggugaaucaauucuauacucuugccccuauggguaacggcaccgggagaaggcgggcacuguga

SEQ ID NO: 18841 - RNA, 1623 nt, Artificial Sequence; identical to SEQ ID NO: 18261
  derived and/or modified sequence opt3 from VP1__Norovirus__BAJ13981

SEQ ID NO: 18842 - RNA, 1623 nt, Artificial Sequence; identical to SEQ ID NO: 17982
  derived and/or modified sequence opt3 from VP1__Norovirus__BAJ13984

SEQ ID NO: 18843 - RNA, 1623 nt, Artificial Sequence; identical to SEQ ID NO: 17982
  derived and/or modified sequence opt3 from VP1__Norovirus__BAJ13987

SEQ ID NO: 18844 - RNA, 1623 nt, Artificial Sequence
  derived and/or modified sequence opt3 from VP1__Norovirus__BAJ13990
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguuccuaaugugcaccuggcaccagccguagcucccaccuuuccuggugagcaguuacuguucuuuaggagcacuaugcccggguguucgggcuauccaaacauggaucucgacugccuucugccucaggaguggguccagcauuucuaccaagaagcggcacccgcccagucugauguggcuuugcuacgguuuguuaauccagacacgggacgugugcuguucgaguguaaacuccacaaguccggcuaugucacaguggcccauaccgggcagcacgaucugguaauuccgccuaacggauacuuucgcuucgacucaugggugaaccaguucuauacucuugcacccauggguaauggcaccgggagaaggcgggcccuguga

SEQ ID NO: 18845 - RNA, 1623 nt, Artificial Sequence; identical to SEQ ID NO: 17982
  derived and/or modified sequence opt3 from VP1__Norovirus__BAJ13993

SEQ ID NO: 18846 - RNA, 1623 nt, Artificial Sequence; identical to SEQ ID NO: 18787
  derived and/or modified sequence opt3 from VP1__Norovirus__BAJ13996

SEQ ID NO: 18847 - RNA, 1623 nt, Artificial Sequence; identical to SEQ ID NO: 18724
  derived and/or modified sequence opt3 from VP1__Norovirus__BAJ13999

SEQ ID NO: 18848 - RNA, 1623 nt, Artificial Sequence; identical to SEQ ID NO: 18787
  derived and/or modified sequence opt3 from VP1__Norovirus__BAJ14002

SEQ ID NO: 18849 - RNA, 1623 nt, Artificial Sequence
  derived and/or modified sequence opt3 from VP1__Norovirus__BAJ14005
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacuguguuaauccugacagucgaagagaugaccaacucucgcuuuccuauaccccuugagaaguuguucacgggaccaagcuccgccuucgugguucagccccagaaugguagauguacuaccgacggcgugcugcuagggacaacucaacucucaccugucaacauuugcaccuuuaggggagaugugacacauaucgcaggcagucggaauuacaccaugaaccuggcuagccuuaauuggaacaauuaugacccaacggaagagauuccggcuccccuggguacuccugauuucguagggaaaauccagggaguuuugacacagaccacuaagggcgacggcucuacacgcgggcacaaggccaccguguacacgggauccgccccauuuacccccaaacucgguucaguccaguucagcacagacacugaaaacgauuuugagauccaucaaaauaccaaguucacaccugugggcgucauucaggacgggaguacuacccaccgaaacgaaccacagcaaugggugcugcccucuuacuccggaagaaauguucacaacgugcauuuagcaccggccguagcuccuacauuuccaggcgagcagcuccucuucuuuaggagcaccaugcccgguuguucgggguauccuaauauggaucuugacugccuguugccccaggaguggguccagcacuucuaccaagaagcggcaccagcccagucugauguggcucuacugcgguuuguuaacccugacacuggccgugugcuguucgaguguaaacugcauaaguccggauaugucacgguggccuacacaggccagcacgaucuuguaauacccccaaacggguauuuucgcuucgacucaugggugaaucaguucuacacccuggcaccgaugggaaacgguacuggcagaaggcgggccuuguga

SEQ ID NO: 18850 - RNA, 1623 nt, Artificial Sequence
  derived and/or modified sequence opt3 from VP1__Norovirus__BAJ14008
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccugucuuaaccguggaagagaugacgaacucucgcuuucccaucccacuggagaaacuuuucacuggacccagcggugccuucguugugcagccucagaauggcagauguaccacagacggggucuugcugggaacuacccagcuauccccagugaacauaugcacauuuaggggcgauguaacccauauugcagguucacggaauuacacgaugaaccucgcuagucugaauuggaacaauuaugacccgacugaagagauccccgccccucuugggacaccagauuucguuggaaagauucaaggcgugcugacccagacuacaaagggcgacgggagcacccgcggacacaaggcuacggucuacaccgguucugcccccuuuacaccuaaauugggcuccgugcaguucucaacugacaccgaaaacgauuuugagacacaucagaauacuaaguucaccccagucggggugauccaagacggaagcacaacccaccgaaacgaaccccagcaguggguucucccgaguuacucuggcagaaaugugcacaacguacaucuggccccugcagucgcuccaacuuuucccggugagcaauuacuguucuuuagguccacgaugccuggguguagcggcuaucccaauauggaucucgacugccuucugccacaggagugggugcagcacuucuaccaggaagcggccccugcacaaucggagguugcuuugcuacgguuugugaaccccgauacaggacguguccuguucgaauguaaacuccauaagucuggcuaugugaccguagcccacacugggcagcacgaccuggugaucccaccgaacggauacuuucgcuucgauuccuggguuaaucaguucuauacccuugcaccuauggguaacggcacagggagaaggcgggcccuguga

SEQ ID NO: 18851 - RNA, 1623 nt, Artificial Sequence
  derived and/or modified sequence opt3 from VP1__Norovirus__BAJ14011
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagauccaucaaaauaccaaguucacaccagugggcgucauucaggacgggaguacuacccaccgaaacgaaccccagcaaugggugcucccgucuuacuccggaagaaauguucacaacgugcaucuggccccugcaguagcuccaacauuucccggcgagcaguuacuguucuuuaggagcaccaugccugguuguucgggguaucccaauauggaucucgacugccuucugccacaggaguggguccagcacuucuaccaagaagcggccccugcacagucugauguggcuuugcuacgguuuguuaaccccgacacuggccgugugcuguucgaguguaaacuccauaaguccggauaugucacgguggccuacacaggccagcacgaucugguaauaccaccgaacggguauuuucgcuucgacucaugggugaaucaguucuacacccuugcaccuaugggaaacgguacuggcagaaggcgggcccuguga

SEQ ID NO: 18852 - RNA, 1623 nt, Artificial Sequence; identical to SEQ ID NO: 17982
  derived and/or modified sequence opt3 from VP1__Norovirus__BAJ14014

SEQ ID NO: 18853 - RNA, 1623 nt, Artificial Sequence
  derived and/or modified sequence opt3 from VP1__Norovirus__BAK43269
auggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggcuuuauaauggcuacgccggugggauggaggugcagguuaugcuggcuggaaacgccuucaccgcaggcaaguugguguuucccgcugucccuccacauuucccgaucgaaaaucucaguccccagcagauuacaauguuuccucacgugaucauugauguacgcacucuggagccaguucugcuccccuuaccugacgugcgaaacaauuucuuucauuauaaccaaaaagaugacccaaagaugcguaucgucgccaugcuguacacaccccuuagaagcaauggcuccggggaugacguguucaccgugucuugcagggucuugacccggccgucgccugauuuugacuucacuuaucugguucccccaacaguggaaucaaaaaccaagccuuuuacgcuacccauacucacucugggagagcuuagcaacagucgcuucccaguauccaucgaucagauguacaccucucccaacgaggugauuagcguccagugucagaaugguagaugcacacuggacggcgaauugcaagggacuacccagcuccagguguccggaaucugugcguuuaaaggcgagguuacagcccaccuucaugauaacgaccacuuauauaauauuaccaucacgaaccugaaugguucaccuuucgacccaagugaagauauaccggcaccccucggggugccugacuuccagggaagggucuuuggcauuaucagccaacgggauaagcacaacucuccaggccauaaugagcccgcuaaccgcgggcacgacgccgugguaccuacuuacacagcucaguacaccccaaaacuuggacagauucaaaucgguacuuggcagacagaugaccugaccguuucccagcccgugaaguucacgccggucggcuugaaugauaucgaacauuuuaaccaguggguggucccucgauaugccggggcacuaaaucugaacaccaaucucgccccaucaguggcucccguuuucccuggagagagacugcuguuuuucaggagcuacauuccccugaagggcgguuaugggaacccagcgauagacugcuugcucccucaagagugggugcagcacuuuuaccaggaagcagcccccaguaugucugagguagcucugguccgguauaucaauccagauacaggccgugccuuauucgaagcaaaacugcaccgcgccggauuuaugacuguguccagcaacaccucggcuccgguuguggucccugccaacggcuacuucagauuugacucuugggugaaucaguucuauucccuagcacccauggggacaggaaacgguaggcggcgaguacaauga

SEQ ID NO: 18854 - RNA, 1623 nt, Artificial Sequence
  derived and/or modified sequence opt3 from VP1__Norovirus__BAK43272
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacucaaaacgauuuugaaacccaucagaauacaaaguucacuccagugggcgucauccaggacgggggaaccacacaccgaaacgagccccaacagugggugcucccgaguuacucuggcagaaauguuccuaacgugcaccuggcaccagccguagcucccaccuuuccuggugaacaguuacuguucuuuagguccacuaugcccggguguagcggcuauccaaauauggaucucgacugccuucugccucaggaguggguccaacauuucuaccaggaggcggcacccgcccagucggauguggcuuugcuacgguuuguuaacccagacacgggacgugugcuguucgaauguaaacuccacaagucucgcuaugucacaguggcccauaccggccagcacgaucugguaauuccgccuaacggguacuuuagauucgacuccugggugaaucaauucuauacucuugcacccaugggaaacgguaccggcaggcggcgagcccuguga

SEQ ID NO: 18855 - RNA, 1647 nt, Artificial Sequence
  derived and/or modified sequence opt3 from VP1__Norovirus__BAK43275
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugguugccaugcuguacacaccccucagagcaaauaacucuggagaugacguguucaccgucucguguaggguguuaacucggccuucaccagauuuuagcuucaauuuucuggugcccccgaccgucgagaguaagacaaaaccuuucacccuucccauuuugacuaucuccgaaaugucuaacagccgcuuuccaguuccuauagacucccugcauacaucacccaccgagaauauugugguacagugccagaacgguagagugacgcuagauggcgagcucauggggacuacccaacugcuuccaagucagaucugugcuuucaggggaguccugacacggagcacuucucgcgccuccgaccaggcugauaccgccacaccccgauuguucaauuauuacuggcacauucagcucgcaaaccugaauggcaccccuuaugacccagccgaagacaucccgggucccuuagggacgccugauuuuagaggaaagguguucggcguugcuugccaaaggaacccagacuguacuacacgggcgcaugaggcaaaaguggauaccacugccggccguuuuacacccaagcuggggucacucgaaaucagcaccgagaguggagacuucgaucagaaucagccuacgcgcuuuaccccagucgguauuggcguggaccacgaagcugauuuccaacaguggucucuucccgacuacuccgggcaguuuacacacaacaugaaucuggccccggcaguagccccuaacuucccaggagagcaguugcuauuuuucagaagccaacugcccucgucuggcgguagguccaaugggauacucgauugccugguuccucaggagugggugcagcauuuuuaccaggaaucagcucccgcccaaacucaggucgcacuugugcgguaugucaacccagacaccggccgagugcuguucgaggcgaaguugcacaaacucggauuuaugacaaucgcuaagaacggcgauaguccuauuacuguucccccaaauggguacuuccgcuucgaaagcugggugaacccguuuuauacccuggccccuaugggaacagguaauggcagaaggcggauccaguga

SEQ ID NO: 18856 - RNA, 1623 nt, Artificial Sequence
  derived and/or modified sequence opt3 from VP1__Norovirus__BAK43278
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcuccaccacacccaggaacgaaccgcaacaguggguuuugccuagcuacucggggcggaauacccauaacgugcaccucgccccagcaguagcccccacuuuuccuggagagcagcuguuauucuuucguucuacgaugcccggcuguuccgguuauccaaauauggaucuggacugccuccuuccucaggaauggguccaauacuucuaucaggaggcugcgcccgcacagucagauguggcccuguugcgcuuuguuaacccagacacagggagagugcuauucgaguguaagcugcacaaaaguagcuacgucaccguggcucauacuggccagcacgaucucguaaucccgccuaacggauauuuuagguucgacuccugggugaaucaauucuacacccuggcccccaugggcaacgggacaggacggcgacaugcacuuuga

SEQ ID NO: 18857 - RNA, 1623 nt, Artificial Sequence
  derived and/or modified sequence opt3 from VP1__Norovirus__BAK43284
auggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaguuuagaacugggaccugagcuaaauccauaccucgcgcaccuggcacggauguauaacggcuacgccggugggauggaggugcagguuaugcuugcuggaaaugccuucaccgcaggcaagcugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaagaugacccuaagaugcguauuguggcgauguuauacaccccacugagauccaacggcucuggggaugacguguucacagucucgugcaggguucuuacccggcccucaccggauuuugacuucacuuauuuggugccucccacaguagaaagcaaaaccaagccauuuacgcugccuauccuaacucucggagagcugaguaauucccgcuucaccgugucuauagaucagauguacacaagccuuaacgaggucaucuccgugcagugucagaacgguagaugcacucuggacggcgaauugagggggaccacacaacuccagguuucaggaauuugugccuuuaaaggcgaggugaccgcacacguccaugauaaugaccaccuguauaacgugacgaucacuaauuuaaacgguagucccuucgacccaagcgaagauguacccgcuccucuggggguuccagacuuccagggacggguguuuggcauuaucucucagcgcgauaagcacaauuccccgggccauaacgagcccgccaaucgagggcacgacgcugucgugccuacauacaccgcccaauacacuccaaagcucggacagauacagauugguacauggcaaaccgaugaccuuacggucaaccagcccgugaaauucaccccuguuggccugaaugauacagaacauuuuaaccagugggugguaccaagauaugcaggggccuugaaucuaaacacuaaucuggcucccucagucgcgccgguguucccuggagagaggcuccuguuuuuccggagcuacguuccacuuaagggcgguuaugggaaccccgcaaucgacugccuguugccucaggagugggugcaacacuuuuaccaggaagccgcucccaguaugucugaggucgcccucgugcguuauauuaauccagauaccggccgcgcacuguucgaagccaaauuacacagagcuggauuuaugacaguauccagcaacacuucggccccugugguuguccccgcaaacggcuacuucagguuugacucuugggugaaucaguucuauucccuggcgccaauggggaccggaaacggucggcgacgcgugcaguga

SEQ ID NO: 18858 - RNA, 1644 nt, Artificial Sequence
  derived and/or modified sequence opt3 from VP1__Norovirus__BAL14785
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaggaugucuuuacaguuucaugucgcguguuaacuagaccagcccccgacuucgaguuuaccuuccugguaccgccuacaguggaaagcaagaccaaacccuuuacucuuccaauuuugacacugggcgagcuaaguaacuccagguucccugcgcccaucgauaugcucuauaccgacccaaaugaagggauugucgugcaaccccagaacggacggugcacgcuggaugguacucuucagggcaccacacagcugguuccuacucaaaucugugccuuucgcgggaccuugauaggacagacaucucgaagcuccgacucaaccgauagugcaccaagaaggcgggaccacccgcuccaugugcagcugaagaauuuagauggcacgcaauacgaccccacugacgaggucccugcugugcugggugccauugauuucaaagggacaguauucggaguugcuagccagcgugacgugucuggccagcaggucggcgccacccgcgcacacgaagugcacaucuccacuacagauccaagauauacccccaagcucgggucaauucuuaugaggagcgagagugacgauuuugucacgggacaaccugugcgguucaccccaaucgguaugggcgacaacgauuggcaucagugggagcugcccgacuacucugggcacuugacacuaaauaugaaccuggccccggcuguugcgccugcauuuccaggagaacgaauccucuucuuucgcuccauggugcccagcgccggcgguuacgggucgggccagauugauugccugauaccucaggaguggguacaacauuucuaucaggaagcugcccccucucaguccgcagucgcccuuaucagauacgugaauccagacacuggaaggaacauuuuugaggcuaagcugcaccgggaaggcuucaucaccguugccaauucagggaacaauccuauaguggugcccccaaacggauauuuucgcuucgaggcaugggucaaucaguuuuacacauugacuccgauggguaccggccaagggagaaggcguaaccaguga

SEQ ID NO: 18859 - RNA, 1749 nt, Artificial Sequence
  derived and/or modified sequence opt3 from VP1__Norovirus__BAR88157
augaagauggccagcuccgacgcugcaucucccucaagugauggcgccgcgaaccuggugccugagaucaauaacgaagucauggcucucgagccaguugccggggcacagcuugccgcuccgguggcagaccaauucaaugccauugaucccuggauaagacagaacuuuguacaggcuccugaaggagaguucaccgugagcccaaggaaugcccccggugaaauccuguugaacuuagagcugggcccucaccuaaauccauuucuccagcaucuggcgcaaauguacaacgcauaugccgggggaauggagguccaggugguucuugcuggcaaugccuucacagcagguaaaauuaucuuugcugccauucccccucacuucccaccggaacggcuguccgcggcccaggcaacucaguuuccccaugugaucauagacguccgccaauuggagccuaucgugcucccacugcccgauguacgacacaaccuguuccauuuuaaucagcagaacgacgaacguaugagacucguugcuuucuuauacacgccucugagggccaauucugggucgggagaugacguguuuaccgucucaugccgggugcuuacacgcccaagccccgauuucgaguuuauguucuuggugccgccuacugucgagagaaagaccguugcuuucagucugccccagcuaacagugggcgaaauguccaacucuagguggccagcccggauuaccacuaugaucgcagacccucaccucccccaaguacugcgcauucagaauggccgauguacacuugaugggacccugaugggaacgacucaguugaacccaaacgacaucugcagagugagggguuauuuuagcaauucccggccccaagucaugugugagggcgaagaugacgcccucgaccaggcuucacugggggcggagccuauacgugaucaggcaccaggauuacgcacccaggccagaaguacagaaaggugguucgcugugacugagcugaacggccaagccuacgacccguuuggugaucagcccgcaccucucgggguuccagacuucgaggcccggauugugggagcucuuguccgacugcccggcaccaauccuacaagcaacucucgcuuugaagaugccuggaucgacaccaauaaccagacgacuuaugcaccagcggcuggcaugguggccauuacaaccuccgaugacucaagcaguaauuacgcaaacgaucagguaugcgaguucuugccccuagggguugacaucacuaauucuacaccguauaacgaauuugaucugccuuccuacggagguagcgccucgucuggcaauagaaaccucgcuccaaccguggcccccacguucccuggggagaucguccugcuuuuuggauccaauaugcccgugcaaaacaggucagcaggcaccaguaauaaagaaauucggugucuguugccaaacgaguacauacagcaccucuaugacacacaggcuccuagccuguccgacgucgccuuagugcgcuacaucaaccccgauacugguagaguucuguucgaggcgaagcuacauagggacggguuuaugaccgugaaugccucugcuacaacuguacucccagucgauggccacuuccguuuugacagcugggugaaccaguucuaugcacugucaccgguuggaaaugccaguggccggcgagggagaaacaggcgcguggauuga

SEQ ID NO: 18860 - RNA, 1623 nt, Artificial Sequence; identical to SEQ ID NO: 18261
  derived and/or modified sequence opt3 from VP1__Norovirus__BAS29993

SEQ ID NO: 18861 - RNA, 1623 nt, Artificial Sequence
  derived and/or modified sequence opt3 from VP1__Norovirus__BAS29996
augaagauggccagcaacgacgcuacccccuccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaaaucauuuucgccgcagugccuccaaauuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcuccgccuucgugguucagccucagaacgguagauguaccacagacggcguguugcuggggacuacccaacuaucaccagucaauauuugcacauuuaggggagaugugacccauaucgcaggcagucggaacuacacgaugaaucucgcuagccugaacuggaauaacuaugacccgacugaagagauucccgccccucuugguacaccagauuucguagggaagauccagggaguucugacccagacuacaaagggcgacggcucuacccgcgggcacaaggcuacgguguacaccggauccgcccccuuuacaccuaaauuggguucaguccaguucagcacugacaccgaaaaugauuuugagacacaucaaaacacuaaguucaccccagugggcgucauccaggacgggggaacaacccaccgaaaugaaccccagcaaugggugcucccgaguuacucuggcagaaacguuccuaaugugcaccuggcaccagccguagcucccacuuuuccuggugagcaguuacuguucuuuagguccacgaugcccggguguagcggcuauccaaacauggaucucgacugccuucugccucaggaguggguccagcauuucuaccaagaagcggcacccgcccagucggauguggcuuugcuacgguuuguuaauccagacacaggacgugugcuguucgaguguaaacuccacaagucuggcuaugucaccguggcccauacugggcagcacgaucugguaauuccgccuaacggauacuuucgcuucgacuccugggugaaccaguucuauacccuugcacccauggguaauggcacagggagaaggcgggcccuguga

SEQ ID NO: 18862 - RNA, 1623 nt, Artificial Sequence
  derived and/or modified sequence opt3 from VP1__Norovirus__BAS29999
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucgggacuacaccaugaaucucgcuagccugaacuggaauaacuaugauccgacggaagagauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccaguucagcacagauacugaaaaugacuuugagacccaucaaaacacaaaguucacuccagugggcgucauccaggaugggggaaccacacaccgaaaugaaccccagcaaugggugcucccgaguuacucuggcagaaacguuccuaaugugcaccuggcaccagccguagcucccaccuuuccuggugagcaguuacuguucuuuagguccacuaugcccggguguagcggcuauccaaacauggaccucgauugccuucugccucaggaguggguccagcauuucuaccaagaagcggcacccgcccagucggagguggcuuugcuacgguuuguuaauccagacacgggacgugugcuguucgaauguaaacuccacaagucuggcuaugucacaguggcccauaccgggcagcacgaucugguaauuccgccuaacggauacuuucgcuucgacuccugggugaaccaguucuauacucuugcacccauggguaauggcaccgggagaaggcgggcccuguga

SEQ ID NO: 18863 - RNA, 1623 nt, Artificial Sequence
  derived and/or modified sequence opt3 from VP1__Norovirus__BAS30005
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugagacccaucaaaacacaaaguucacuccagugggggucauccaggacggaaguaccacacaccgaaaugaaccccagcaaugggugcucccgucuuacuccggcagagauguucacaacgugcaucuggccccugcaguagcuccaaccuuucccggugagcaguuacuguucuuuaggagcacuaugccuggguguucgggcuaucccaauauggaccucgauugccuucugccacaggaguggguccagcacuucuaccaagaagcggccccugcacagucugacguggcuuugcuacgguuuguuaaccccgauacgggacgugugcuguucgaguguaaacuccauaaguccggcuaugucacaguggcccacaccgggcagcacgaccugguaauuccaccgaauggauacuuucgcuucgauucaugggugaaccaguucuauacucuugcaccuauggguaacggcaccgggagaaggcgggcccuguga

SEQ ID NO: 18864 - RNA, 1623 nt, Artificial Sequence
  derived and/or modified sequence opt3 from VP1__Norovirus__BAS30008
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacugcuggcaaaaucauuuucgccgcagugccuccaaacuuuccgacggagggccucucccccucucagguaaccauguucccucauaucauaguugacgugcgccagcuggagccaguccuuaucccccugccugaugugcgaaauaacuuuuaucacuacaaucaaucgaacgacucaacaauuaaguugaucgcuaugcucuauacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccauaucgcagguucacggaauuacacgaugaaccucgcuagucugaauuggaacaauuaugacccgacugaagagauucccgccccucuugggacaccagauuucguaggaaagauccaaggcguucugacccagacuacaaagggcgacgggagcacccgcggacacaaggcuacgguguacaccgguucugcccccuuuacaccuaaauugggcuccguccaguucucaacugacaccgaaaacgauuuugaggcacaucagaauacaaaguucacuccagugggggucauccaagacggaagcaccacacaccgaaacgaaccccagcagugggugcucccgaguuacucuggcgguaauguucaaaacgugcaccuggccccugcuguagcgccaaccuuucccggggagcaguuacuguucuuuagauccacuaugccuggcuguagcggauaucccaauauggaucucgacugccuucugccacaggaguggguccagcauuucuaccaagaagcagccccugcucagucggauguggccuugcuaagguuuguuaaccccgacacgggccgggugcuguucgaguguaaacuccacaagucuggguaugucacaguggcacauaccggacagcacgaucugguaauuccaccgaacgguuacuuucguuucgacuccugggugaaucaguucuauacucuugccccuaugggcaacgggaccggacgcagaagggcucuguga

SEQ ID NO: 18865 - RNA, 1623 nt, Artificial Sequence; identical to SEQ ID NO: 18712
  derived and/or modified sequence opt3 from VP1__Norovirus__BAS30011

SEQ ID NO: 18866 - RNA, 1623 nt, Artificial Sequence
  derived and/or modified sequence opt3 from VP1__Norovirus__BAS30014
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccauuuuuccuggugagcaguuacuguucuuuagguccaccaugcccggguguagcggcuauccaaauauggaucucgacugccuucugccucaggaguggguccagcauuucuaccaagaagcggcacccgcccagucggauguggcuuugcuacgguuuguuaacccagacacuggacgugugcuguucgaguguaaacuccacaagucuggcuaugucacgguggcccauacagggcagcacgaucugguaauaccgccuaacggauacuuucgcuucgacuccugggugaaucaguucuauacccuugcacccauggguaacggcacugggagaaggcgggcccuguga

SEQ ID NO: 18867 - RNA, 1623 nt, Artificial Sequence
  derived and/or modified sequence opt3 from VP1__Norovirus__BAS30017
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccacuuucgugguucagccucagaaugguagauguaccacagacggcguguugcuggggacuacccaacuaucaccagucaacauuugcacauuuaggggagaugugacccauaucgccggcagucggaauuacacgaugaaccucgcaagccugaauuggaacaauuaugacccgacugaagagauucccgcuccucuugguacaccagauuucguagggaagauccagggaguucugacccagacuacaaagggcgacggcucuacccgcgggcacaaggccacgguguacaccggauccgcucccuuuacaccuaaauuggguucaguccaguucggcacugacaccgaaaacgauuuugagacacaucaaaauacuaaguucaccccagugggggucauccaggacggaggcacaacccaccgaaacgaaccccagcaaugggugcucccgagcuacagugguagaaauguuccuaacgugcaccuggccccagcaguagcccccacuuuuccuggggagcaguuacuguucuuuaggucuacgaugcccggcuguuccggauauccaaauauggaucucgacugccuucugccucaggaguggguccagcauuucuaccaagaagcugcgcccgcacagagcgauguggccuugcuacgguuuguuaacccagacacaggccgugugcuguucgaguguaaacuccacaagucgggguaugucaccguggcucauacuggacagcacgaucugguaauuccgccuaacgguuacuuucgcuucgacucuugggugaaucaguucuauacccuugcccccaugggcaacgggacaggaagaaggcgggcacuguga

SEQ ID NO: 18868 - RNA, 1623 nt, Artificial Sequence
  derived and/or modified sequence opt3 from VP1__Norovirus__BAS30023
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgaucgagggccucucccccucucagguaacuauguucccucauauaaucguugacgugcgccaacuggagccaguccuuauuccccugccugaugugcgaaauaacuuuuaucacuacaaucagucgaacgacucaacgaucaaguugauugcuaugcucuauaccccacugcgugccaacaaugcgggggaagauguguucacagucagcugcagaguucugacuaggcccaguccggacuuugauuucaucuuucucgugccucccaccguagagucccggacaaaaccauucaccgugccuauauuaacugucgaagagaugacaaacucucgcuuucccauuccacuggagaaacuuuucaccggacccagcuccgccuucgugguucagccucagaaugguagauguacgacugacggcguguugcuggggaccacacaacuaucaccagucaacaucugcacuuuuaggggagaugugacccauauugcaggcagucggaauuacacaaugaaccucgcuagccugaauuggaacaauuaugacccgaccgaagagauccccgccccucuugguacgccagauuucguagggaagauccagggaguucugacucagacaaccaagggcgacggcucuacucgcgggcacaaggcuacaguguacaccggauccgcccccuuuacgccuaaauuggguucaguccaguucagcaccgacacagaaaacgauuuugagacucaucaaaauaccaaguucacaccagugggcgucauucaggacgggggaacuacccaccgaaacgaaccccagcaaugggugcucccgaguuacucuggcagaaauguuccuaacgugcaccuggcaccagccguagcucccacauuuccuggugagcaguuacuguucuuuagguccaccaugcccggguguagcggcuauccaaauauggaucucgacugccuucugccucaggaguggguccagcauuucuaccaagaagcggcacccgcccagucggauguggcuuugcuacgguuuguuaacccagacacuggacgugugcuguucgaguguaaacuccacaagucuggcuaugucacgguggcccauacagggcagcacgaucugguaauaccgccuaacggauacuuucgcuucgacuccugggugaaucaguucuauacccuugcacccauggguaacggcacugggagaaggcgggcccuguga

SEQ ID NO: 18869 - RNA, 1623 nt, Artificial Sequence; identical to SEQ ID NO: 18747
  derived and/or modified sequence opt3 from VP1__Norovirus__BAS30026

SEQ ID NO: 18870 - RNA, 1623 nt, Artificial Sequence
  derived and/or modified sequence opt3 from VP1__Norovirus__BAS30029
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguucacaaugugcaucuggccccugcaguagcuccaaccuuucccggugagcaguuacuguucuuuaggagcacuaugccuggguguucgggcuaucccaacauggaucucgacugccuucugccacaggaguggguccagcacuucuaccaagaagcggccccugcacagucugauguggcuuugcuacgguuuguuaaucccgacacgggacgugugcuguucgaguguaaacuccauaaguccggcuaugucacaguggcccacaccgggcagcacgaucugguaauuccaccgaacggauacuuucgcuucgacucaugggugaaccaguucuauacucuugcaccuauggguaauggcaccgggagaaggcgggcccuguga

SEQ ID NO: 18871 - RNA, 1623 nt, Artificial Sequence
  derived and/or modified sequence opt3 from VP1__Norovirus__BAS30035
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucggcacagacacugaaaacgauuuugagacccaucaaaauacaaaguucacuccagugggggucauccaggacggaggcaccacacaccgaaacgaaccccagcaaugggugcucccgagcuacagugguagaaauguuccuaacgugcaccuggcaccagccguagcucccaccuuuccuggggagcaguuacuguucuuuaggucuacuaugcccggcuguuccggauauccaaauauggaucucgacugccuucugccucaggaguggguccagcauuucuaccaagaagcggcacccgcccagagcgauguggcuuugcuacgguuuguuaacccagacacgggccgugugcuguucgaguguaaacuccacaagucgggguaugucacaguggcccauaccggacagcacgaucugguaauuccgccuaacgguuacuuucgcuucgacucuugggugaaucaguucuauacucuugcacccaugggcaacgggaccggaagaaggcgggcccuguga

SEQ ID NO: 18872 - RNA, 1623 nt, Artificial Sequence; identical to SEQ ID NO: 18871
  derived and/or modified sequence opt3 from VP1__Norovirus__BAS30038

SEQ ID NO: 18873 - RNA, 1623 nt, Artificial Sequence; identical to SEQ ID NO: 18868
  derived and/or modified sequence opt3 from VP1__Norovirus__BAS30041

SEQ ID NO: 18874 - RNA, 1623 nt, Artificial Sequence
  derived and/or modified sequence opt3 from VP1__Norovirus__BAS30044
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugaaccucugggaccagauuugaaucccuacuuaagccaccuggcucggauguauaacggcuacgccgguggguucgaggugcaggucauucuagcgggaaaugcauuuacagccggcaaaaucauuuucgcugccgugccuccaaacuuuccgacugagggccucucccccucucagguaacgauguucccucauaucauaguugacgugcgccaacuggaaccaguccuuaucccccugccugaugugcgaaauaacuuuuaucacuacaaucagucgaacgacucaaccauuaaguugaucgcaaugcucuauacaccacugcgugcuaacaaugccggggaggauguguucacugucagcugcagaguucugaccaggcccaguccggacuuugauuucauuuuucucgugccucccacaguagaaucccggaccaaaccauucacugugccuaucuuaacagucgaggagaugaccaacucucgcuuucccauaccacuggaaaaacuuuucacgggacccagcuccgcguucgugguucagccucagaaugguagauguacuaccgacggcguguugcuggggacaacucaacuaucaccagucaacauuugcaccuuuaggggagaugugacacauaucgccggcagucggaauuacaccaugaaccucgcaagccugaauuggaacaauuaugacccgacggaggaaauucccgcuccucuugguacuccagauuucguagggaagauccagggaguucugacacagaccacuaagggcgacggcucuacacgcgggcacaaggccaccguguacacgggauccgcucccuuuaccccuaaauuggguucaguccaguucagcacagacacugagaacgauuuugaaacccaucaaaauacaaaguucacuccagugggcgucauccaggacgggggaaccacacaccgaaacgagccccagcaaugggugcucccgaguuacucuggcagaaauguuccuaacgugcaccuggccccagcaguagcccccaccuuuccuggugagcaguuacuguucuuuagguccacuaugcccggguguagcggcuauccaaauauggaucucgacugccuucugccucaggaauggguccagcauuucuaccaagaggcugcgcccgcacagucggauguggccuugcuacgguuuguuaacccagacacgggacgugugcuguucgaauguaaacuccacaagucuggcuaugucacaguggcucauaccgggcagcacgaucugguaauuccgccuaacggauacuuucgcuucgacuccugggugaaucaguucuauacucuugcccccauggguaacggcaccgggagaaggcgggcacuguga

SEQ ID NO: 18875 - RNA, 1623 nt, Artificial Sequence; identical to SEQ ID NO: 18866
  derived and/or modified sequence opt3 from VP1__Norovirus__BAS30047

SEQ ID NO: 18876 - RNA, 1623 nt, Artificial Sequence; identical to SEQ ID NO: 18261
  derived and/or modified sequence opt3 from VP1__Norovirus__BAS30050

SEQ ID NO: 18877 - RNA, 1623 nt, Artificial Sequence
  derived and/or modified sequence opt3 from VP1__Norovirus__BAS30053
augaagauggccagcaacgacgcuacccccuccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaaaucauuuucgccgcagugccuccaaauuuuccgacggagggccucucccccucucagguaaccauguucccucauaucauaguugacgugcgccaacuggagccaguccuuaucccccugccugaugugcgaaacaauuuuuaucacuacaaccagucgaaugacucaacaauuaaguugaucgcuaugcucuauacuccacugcgugccaacaacgcgggggaagauguguucaccgucagcugcagaguucugacaaggcccaguccggacuuugauuucauuuuucucgugccucccaccguagagucccggacuaaaccauucacagugccuaucuuaaccgucgaagagaugacuaauucucgcuuucccauaccacuggagaaacuuuucacgggacccagcuccgccuucgugguucagccucagaacgguagauguaccacagacggcguguugcuggggacuacccaacuaucaccagucaauauuugcacauuuaggggagaugugacccauaucgcaggcagucggaacuacacgaugaaucucgcuagccugaacuggaauaacuaugacccgacugaagagauucccgccccucuugguacaccagauuucguagggaagauccagggaguucugacccagacuacaaagggcgacggcucuacccgcgggcacaaggcuacgguguacaccggauccgcccccuuuacaccuaaauuggguucaguccaguucaauacugacaccgaaaacgauuuugagacacaucaaaauacuaaguucaccccagugggcgucauccaggacgggagcacaacccaccgaaacgaaccccagcaaugggugcucccgaguuacucuggaagaaauguuccuaacgugcaccuggcaccagccguagcucccacuuuuccuggcgagcaguuacuguucuuuagguccacgaugcccgguuguagcggguauccaaauauggaucucgacugccuucugccucaggaguggguccagcauuucuaccaagaagcggcacccgcccagucggauguggcuuugcuacgguuuguuaacccagacacaggccgugugcuguucgaguguaaacuccacaagucuggauaugucaccguggcccauacuggccagcacgaucugguaauuccgccuaacggguacuuucgcuucgacuccugggugaaucaguucuauacccuugcacccaugggaaacgguacaggcagaaggcgggcccuguga

SEQ ID NO: 18878 - RNA, 1623 nt, Artificial Sequence; identical to SEQ ID NO: 18868
  derived and/or modified sequence opt3 from VP1__Norovirus__BAS30056

SEQ ID NO: 18879 - RNA, 1623 nt, Artificial Sequence
  derived and/or modified sequence opt3 from VP1__Norovirus__BAS30059
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaagacacaaaguucacuccagugggcgucauccaggaugggggaaccacacaccgaaaugaaccccagcaaugggugcucccgaguuacucuggcagaaacguuccuaaugugcaccuggcaccagccguagcucccaccuuuccuggugagcaguuacuguucuuuagguccacuaugcccggguguagcggcuauccaaacauggaccucgauugccuucugccucaggaguggguccagcauuucuaccaagaagcggcacccgcccagucggacguggcuuugcuacgguuuguuaauccagauacgggacgugugcuguucgaguguaaacuccacaagucuggcuaugucacaguggcccauaccgggcagcacgaccugguaauuccgccuaacggauacuuucgcuucgauuccugggugaaccaguucuauacucuugcacccauggguaauggcaccgggagaaggcgggcccuguga

SEQ ID NO: 18880 - RNA, 1623 nt, Artificial Sequence; identical to SEQ ID NO: 18787
  derived and/or modified sequence opt3 from VP1__Norovirus__BAS30062

SEQ ID NO: 18881 - RNA, 1623 nt, Artificial Sequence
  derived and/or modified sequence opt3 from VP1__Norovirus__BAS30065
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagugguaaaaacuacgcucuccgcuguuccuccaaacuucccgaccgagggccugucucccucacaggugacaauguuuccucauaucauugucgacgugcgccaacuugagccagugcugauccccuugccugauguccgaaauaacuucuaucacuacaaucagucgaacgacagcacuauaaagcucaucgccaugcuguauaccccacugcgugcaaacaaugcuggcgaagauguuuuuacagugaguugcagaguacucaccaggcccuccccggacuucgauuuuauuuucuuagugccucccacugucgagucucggacaaaaccauuuaccgugccuauccugacgguugaagagaugacuaacagccgcuuccccauuccacuugagaaguuguuuaccgggcccuccucagccuucgugguccagccucagaauggaagauguacaacugacggugugcugcuaggcaccacacaacucaguccaguaaacaucugcaccuucaggggagauguuacgcauauagcggggagccggaauuacacuaugaaccuggccucucuuaauuggaacaauuaugacccgacagaagagauucccgcaccucugggcaccccagauuuuguggguaaaauccagggggucuugacucagacaaccaagggagacggcuccacgcgcggccacaaggcuaccguguacacagggucagcccccuucacuccuaaacucggaagcguccaguuuaguaccgacacagaaaacgauuucgagacucaucaaaauaccaaguuuacaccaguggguguuauucaggacggcgggaccacucaccgaaacgaaccccagcaaugggugcugccgucuuacuccggaagaaauguaccuaacguccacuuagcuccagccguggcacccacguucccuggcgagcagcugcucuuuuucaggagcacaaugcccgguuguucgggguauccaaauauggaucuugacugccuguugccucaggaguggguucagcauuuuuaccaagaagccgcucccgcgcagucugauguggcacuacugcgguucgucaacccagacaccggccgugugcucuuugaguguaaacugcacaaguccggauauguaacuguggcccauaccggccagcacgaucuuguuaucccgccuaacggguacuuccgcuuugacucaugggucaaucaguucuauacacuggcucccaugggaaacgguaccggcagaaggcgggccuuguga

SEQ ID NO: 18882 - RNA, 1623 nt, Artificial Sequence
  derived and/or modified sequence opt3 from VP1__Norovirus__BAS30068
augaagauggccagcaacgacgcuaccgcauccgauggcucugccgcgaaucuggugcccgaggucaacaaugaaguuauggcucucgagccugugguaggggccgcaaucgccgcuccaguggcaggacagcaaaacgucauugacccguggauaagaaauaacuucgugcaggcccccgguggcgaauuuacaguuucaccuaggaaugcuccaggggagauccuuuggagugcaccccugggaccugauuugaacccauacuuaagccaccuggcgcggauguauaauggcuacgccgguggguucgaagugcaggucauucuagccggaaacgcuuuuacugccggcaaaaucauuuucgcagcugugcccccuaauuuuccaaucgagggccucuccccgucucagguaacgauguucccccauauaaucguugacgugcgccaacuggagccuguccuuauuccacugcccgaugugcgaaacaauuuuuaucacuacaaccagucgaaugacucaaccaucaaguugauugccaugcucuauacaccucugcgugcgaacaacgccggggaagauguguucacugucagcugcagaguucugaccaggccaagucccgacuuugauuucaucuuucucgugccgccuacaguagagucccggaccaaacccuucacugugccaauauuaacagucgaagagaugaccaauucucgcuuuccuauuccccuggagaaacuuuucacgggaccaagcuccgcauucgugguucagccccagaacgguagauguacuaccgacggcguguugcuggggacaacucaacuaucaccugucaauaucugcaccuuuaggggagaugugacacauauugcuggcagucggaacuacaccaugaaucucgccagccugaacuggaauaacuaugacccaacggaagagaucccggcuccccuugguacuccugauuucguagggaagauccagggaguucugacacagaccacuaagggcgacggcucuacacgcgggcacaaggccaccguguacacgggauccgcaccauuuacccccaaauuggguucaguccaguucagcacagacacugaaaaugauuuugagacccaucaaaacacaaaguucacuccugugggcgucauucaggacgggggaaccacacaccgaaaugaaccacagcaaugggugcuccccaguuacucuggcagaaacguuccgaaugugcaccuggccccugcuguagcgccaaccuuucccggugagcaguuacuguucuuuagguccacuaugccuggguguagcggcuaucccaacauggaucucgacugccuucugccacaggaguggguccagcauuucuaccaagaagcagccccugcucagucggauguggccuugcuacgguuuguuaaucccgacacgggacgugugcuguucgaguguaaacuccacaagucuggcuaugucacaguggcacauaccgggcagcacgaucugguaauaccaccgaacggauacuuucgcuucgacuccugggugaaccaguucuauacucuugccccuauggguaauggcaccgggagaaggcgggcucuguga

SEQ ID NO: 18883 - RNA, 1623 nt, Artificial Sequence; identical to SEQ ID NO: 18868
  derived and/or modified sequence opt3 from VP1__Norovirus__BAS30071

SEQ ID NO: 18884 - RNA, 1623 nt, Artificial Sequence; identical to SEQ ID NO: 18868
  derived and/or modified sequence opt3 from VP1__Norovirus__BAS30074

SEQ ID NO: 18885 - RNA, 1623 nt, Artificial Sequence
  derived and/or modified sequence opt3 from VP1__Norovirus__BAS30077
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucacaauuacaccaugaaccucgcuagccugaauuggaacaauuaugacccgacggaagagauucccgccccucuugguacuccagauuucguagggaagauccagggaguucugacacagaccacuaagggcgacggcucuacacgggggcauaaggcuaccguguacacgggauccgcccccuuuaccccuaaauuggguucaguccaguucagcacagacacugaaaacgauuuugagacccaccaaaauacaaaguucacuccagugggcgucauccaggacgggggaaccgcacaccgcaacgaaccccagcaaugggugcucccgaguuacucuggccgaaauguucagaacgugcaucuggccccugcuguagcgccaacauuucccggugagcaguuacuguucuuuagauccaccaugccuggguguagcggcuaucccaauauggaucucgacugccuucugccacaggaguggguccaacacuucuaccaggaagcagccccugcucagucggauguggccuugcuaagguuuguuaaccccgacacuggacgggugcuguucgaguguaaacuccauaagucuggcuaugucacgguggcacacacagggcagcacgaucugguaauuccaccgaacggauacuuucguuucgacuccugggugaaucaauucuauacccuugccccuauggguaacggcacugggcgcagaagggcucuguga

SEQ ID NO: 18886 - RNA, 1623 nt, Artificial Sequence
  derived and/or modified sequence opt3 from VP1__Norovirus__BAS30080
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggccagaucauuuucgccgcagugccuccaaacuuuccgacugagggccucucccccucucaaguaacgauguucccucauaucauaguugacgugcgccagcuggagccaguccuuaucccccugccugaugugcgaaauaacuuuuaucacuacaaucagucgaacgacucaaccauuaaauugaucgcuaugcucuauacaccacugcgugccaacaaugcgggggaagauguguucacugucagcugcagaguucugaccaggcccaguccggacuuugauuucauuuuucucgugccucccacaguagagucccggaccaagccauucacugugccuaucuuaacagucgaagagaugaccaacucucgcuuucccauaccacuggagaaacuuuucacgggacccagcuccgccuucgugguucagccucaaaaugguagauguacuaccgacggcguguugcuggggacaacucagcuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaaaggcgacggcucuacacgcgggcacaaggcuaccguguacacgggauccgcccccuuuaccccuaaguuggguucaguccaauucagcacagacacugaaaacgauuuugagacccaucagaauacaaaauucacuccagugggcgucauccaggacgggggaaccacacaccgaaacgaaccccaacagugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccaacauuucuaccaggaagcggcacccgcccagucggauguggcuuugcuacgguuuguuaacccagacacgggacgugugcuguucgaguguaagcuccacaaaucuggcuaugucacaguggcccauaccgggcagcacgaucugguaauuccgccuaacggauacuuucgcuucgacuccugggugaaucaauucuauacucuugcacccauggguaacggcaccgggagaaggcgggcccuguga

SEQ ID NO: 18887 - RNA, 1623 nt, Artificial Sequence; identical to SEQ ID NO: 18261
  derived and/or modified sequence opt3 from VP1__Norovirus__BAS30083

SEQ ID NO: 18888 - RNA, 1623 nt, Artificial Sequence
  derived and/or modified sequence opt3 from VP1__Norovirus__BAS30086
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccugucuuaacaguggaagagaugaccaacucucgcuuucccaucccacuggagaaacuuuucacgggacccagcuccgccuucguugugcagccucagaaugguagauguacuaccgacggcgucuugcuggggacaacucaacuaucaccagugaacauaugcaccuuuaggggagauguaacacauauugcaaauagucacaacuacaccaugaaucucgcuagccugaacuggaauaacuaugacccgacggaagagauccccgccccucuuggcacuccagauuucguugguaagauucagggggugcugacacagaccacuaagggagacggcucuacacggggccauaaggcuaccgucuacacgggguccgcccccuuuaccccuaaauugggaucagugcaguucagcacagacacugaaaaugauuuugagacccaccaaaacacaaaguucacuccagucggugugauccaggacggcgggaccacacaccgcaaugaaccccagcaauggguucucccgaguuacucuggacgaaacgugcagaauguacaucuggccccugcagucgcuccaaccuuucccggcgagcaguuacuguucuuuagauccacuaugccugguuguagcggguaucccaacauggaucucgacugccuucugccacaggagugggugcaacacuucuaccaggaagcggccccugcacagucggauguugcuuugcuaagguuugugaaccccgacacgggccggguccuguucgaguguaaacuccauaagucuggauaugugacaguagcccacaccggccagcacgaucuggugaucccaccgaauggguacuuucguuucgacuccuggguuaaccaauucuauacucuugcaccuaugggaaaugguaccggccgcagaagggcccuguga

SEQ ID NO: 18889 - RNA, 1623 nt, Artificial Sequence
  derived and/or modified sequence opt3 from VP1__Norovirus__BAS30089
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaguauuugcaccuuuaggggagacgugacacauaucgcaggcagccgggauuacaccaugaaccucgcuucucugaauuggaacaauuaugacccgacggaggaaauucccgccccucuugguacuccagacuucguagggaagauccagggaguucugacacagaccacuaagggcgauggcuccacacgcgggcacaaggcuaccguguacacgggaucagcccccuuuaccccuaaauuggguagcguccaguucaguacagacacugagaacgauuuugaaacccaucaaaauacaaaguucacuccagugggcgucauccaggacgggucuaccgcacaccgaaacgagccccagcaaugggugcucccguccuacagcggaagaaauguucagaacgugcaccuggccccugcuguagcgccaacauuucccggcgaacaguuacuguucuuuaggucgaccaugccugguuguucuggguaucccaauauggaucucgacugccuucugccacaggaguggguccaacauuucuaccaggaggcagccccugcucaguccgauguggccuugcuacgguuuguuaaccccgacacuggccgugugcuguucgaauguaaacuccacaagucaggauaugucacgguggcacauacaggccagcacgaucugguaauuccaccgaauggguacuuucgcuucgacaguugggugaaccaauucuauacccuugccccuaugggaaacgguacuggcagaaggcgggcucuguga

SEQ ID NO: 18890 - RNA, 1623 nt, Artificial Sequence
  derived and/or modified sequence opt3 from VP1__Norovirus__BAS30092
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgaucgagggccucucccccucucagguaacuauguucccucauauaaucguugacgugcgccaacuggagccaguccuuauuccccugccugaugugcgaaauaacuuuuaucacuacaaucagucgaacgacucaacgaucaaguugauugcuaugcucuauaccccacugcgugccaacaaugcgggggaagauguguucacagucagcugcagaguucugacuaggcccaguccggacuuugauuucaucuuucucgugccucccaccguagagucccggacaaaaccauucaccgugccuauauuaacugucgaagagaugacaaacucucgcuuucccauuccacuggagaaacuuuucaccggacccagcuccgccuucgugguucagccucagaaugguagauguacgacugacggcguguugcuggggaccacacaacuaucaccagucaacaucugcacuuuuaggggagaugugacccauauugcaaguagccggaauuacacaaugaaccucgcuucucugaauuggaacaauuaugacccgaccgaagagauccccgccccucuuggcacgccagauuucguagguaagauccaggggguucugacucagacaaccaagggagacggcuccacucgcggccacaaggcuacaguguacaccgggucagcccccuuuacgccuaaauugggaagcguccaguucaguaccgacacagaaaacgauuuugagacucaucaaaauaccaaguucacaccagugggugucauucaggacggcgggacuacccaccgaaacgaaccccagcaaugggugcucccgucuuacuccggaagaaauguuccuaacgugcaccuggcaccagccguagcucccacauuuccuggcgagcaguuacuguucuuuaggagcaccaugcccgguuguucgggguauccaaauauggaucucgacugccuucugccucaggaguggguccagcauuucuaccaagaagcggcacccgcccagucugauguggcuuugcuacgguuuguuaacccagacacuggccgugugcuguucgaguguaaacuccacaaguccggauaugucacgguggcccauacaggccagcacgaucugguaauaccgccuaacggguacuuucgcuucgacucaugggugaaucaguucuauacccuugcacccaugggaaacgguacuggcagaaggcgggcccuguga

SEQ ID NO: 18891 - RNA, 1623 nt, Artificial Sequence
  derived and/or modified sequence opt3 from VP1__Norovirus__BAS30095
augaagauggccagcaacgacgcuaaucccuucgauggcuccgcagccaaccuggugccugaggucaauaacgaaguuauggcgcucgagccagugguaggggcugccaucgcagccccgguggcuggacagcaaaaugucauugaccccuggauaagaaacaauuuugugcaggcaccugguggcgaguucaccguuucuccaaggaacgcccccggggaaauccuuuggucagcuccucugggaccagauuugaaucccuacuuaagucaccuggcccggauguauaacggcuacgcggguggguuugaagugcaggucauucuagcaggaaaugccuucacagcuggcaaaaucauuuuugccgcagugccuccaaacuucccggcugagggccucagccccucccagguaacuauguuuccucauaucauaguugacgugcgccaacuggagccaguccuuaucccccugccugaugugcgaaauaacuucuaucacuacaaucagucuaacgacucgacgauuaaguugaucgccaugcucuauaccccacugcgugcgaacaaugccggggaagauguguuuacagucucaugcagaguucugacuaggcccagcccggacuucgauuuuauuuuccucgugccucccaccguagagagucggacaaaaccauuuaccgugccuaucuuaacugucgaagagaugacaaacucccgcuuccccauaccacuggagaaacuuuucaccggacccucuagcgcauuugugguucagccucagaaugguagauguacgacugacggcguguugcuggggaccacacaacuauccccagucaacauuugcacuuucaggggagaugugacccauaucgcuggcucacggaauuacacaaugaaccucgccagucugaauuggaacaauuaugacccgaccgaagagauucccgcuccucuugguacgccagauuuuguagggaagauccagggaguucugacucagacaaccaagggcgacggcagcacucgcgggcacaaggccacaguguacaccggaucugcacccuucacgccuaaauuggguuccguccaguuuucaaccgacacagaaaacgauuucgagacucaucaaaauaccaaguuuacaccagugggcgucauccaggacgggggaacuacccaccgaaacgaaccccagcaaugggugcucccgagcuacaguggcagaaauguuccuaacgugcaccuggccccagcuguagcgcccacauucccuggugagcaguuacuguuuuucaggucuaccaugcccggguguuccggcuauccaaauauggaucucgacugccuucugccucaggaguggguccagcauuuuuaccaagaagcagcccccgcucagagcgauguggccuugcuacgguucguuaacccagacacuggacgugugcuguuugaguguaaacuccacaagucgggcuaugucacgguggcacauacagggcagcacgaucugguaauuccgccuaacggauacuuccgcuucgacucuugggugaaucaguuuuauacccuugcccccauggguaacggcacugggagaaggcgggcucuguga

SEQ ID NO: 18892 - RNA, 1623 nt, Artificial Sequence
  derived and/or modified sequence opt3 from VP1__Norovirus__BAS30098
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucauugugcagccucagaaugguagauguacuaccgacggcguuuugcuggggacaacucaacuaucaccagugaacaucugcaccuuuaggggagaugucacacauauugcaggcagucggaauuacaccaugaaccucgcuagccugaauuggaacaauuaugacccgacggaagagauccccgccccucuugguacuccagauuucguggggaagauccagggaguacugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauucaggacgggggaaccacacaccgaaacgaaccccagcaauggguccucccgaguuacucuggcagaaaugugccuaacguucaccuggcaccagccguggcucccaccuuuccuggugagcaguuacuguucuuuagguccacuaugcccggguguagcggcuauccaaauauggaucucgacugccuucugccucaggaguggguacagcauuucuaccaagaagcggcacccgcccagucggaugucgcuuugcuacgguuugugaacccagacacgggacguguucuguucgaguguaaacuccacaagucuggcuaugugacagucgcccauaccgggcagcacgaucuggugauaccgccuaacggauacuuucgcuucgacuccuggguaaaucaguucuauacucuugcacccauggguaacggcaccgggagaaggcgggcccuguga

SEQ ID NO: 18893 - RNA, 1623 nt, Artificial Sequence
  derived and/or modified sequence opt3 from VP1__Norovirus__BAS30101
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccgcacaccgaaacgaaccccagcaaugggugcucccgucuuacuccggaagaaauguucagaacgugcaccuggccccugcuguagcgccaacauuucccggcgagcaguuacuguucuuuaggagcaccaugccugguuguucgggguaucccaauauggaucucgacugccuucugccacaggaguggguccaacauuucuaccaggaagcagccccugcucagucugauguggccuugcuacgguuuguuaaccccgacacuggccgugugcuguucgaguguaaacuccacaaguccggauaugucacgguggcacauacaggccagcacgaucugguaauuccaccgaacggguacuuucgcuucgacucaugggugaaucaauucuauacccuugccccuaugggaaacgguacuggcagaaggcgggcucuguga

SEQ ID NO: 18894 - RNA, 1623 nt, Artificial Sequence
  derived and/or modified sequence opt3 from VP1__Norovirus__BAS30104
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucgggacuacaccaugaaucucgcuagccugaacuggaauaacuaugauccgacggaagagauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccaguucagcacagauacugaaaaugacuuugagacccaucaaaacgcaaaguucacaccagugggcgucauccaggaugggaguacuacccaccgaaaugaaccccagcaaugggugcucccgucuuacuccggaagaaacguuccuaaugugcaccuggccccagcuguagcgcccacauuuccuggcgagcaguuacuguucuuuaggagcaccaugcccgguuguucgggguauccaaacauggaccucgauugccuucugccucaggaguggguccagcauuucuaccaagaagcagcccccgcucagucugacguggccuugcuacgguuuguuaauccagauacuggccgugugcuguucgaguguaaacuccacaaguccggauaugucacgguggcacauacaggccagcacgaccugguaauuccgccuaacggguacuuucgcuucgauucaugggugaaccaguucuauacccuugcccccaugggaaaugguacuggcagaaggcgggcucuguga

SEQ ID NO: 18895 - RNA, 1623 nt, Artificial Sequence
  derived and/or modified sequence opt3 from VP1__Norovirus__BAS30107
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcuccgcguucgugguucagccucagaaugguagauguaccacagacggcguguugcuggggacuacccaacuaucaccagucaacauuugcacauuuaggggagaugugacccauaucgccggcagucacaauuacacgaugaaccucgcaagccugaauuggaacaauuaugacccgacugaagagauucccgcuccucuugguacaccagauuucguagggaagauccagggaguucugacccagacuacaaagggcgacggcucuacccgggggcauaaggccacgguguacaccggauccgcucccuuuacaccuaaauuggguucaguccaguucagcacugacaccgaaaacgauuuugagacacaccaaaauacuaaguucaccccagugggcgucauccaggacgggggaacaacccaccgcaacgaaccccagcaaugggugcucccgaguuacucuggccgaaauguucagaacgugcaucuggccccugcaguagccccaacuuuucccggugagcaguuacuguucuuuagauccacgaugccuggguguagcggcuaucccaauauggaucucgacugccuucugccacaggaguggguccaacacuucuaccaggaagcugcgccugcacagucggauguggccuugcuaagguuuguuaaccccgacacaggacgggugcuguucgaguguaaacuccauaagucuggcuaugucaccguggcucacacugggcagcacgaucugguaauuccaccgaacggauacuuucguuucgacuccugggugaaucaauucuauacccuugccccuauggguaacggcacagggcgcagaagggcacuguga

SEQ ID NO: 18896 - RNA, 1623 nt, Artificial Sequence; identical to SEQ ID NO: 18868
  derived and/or modified sequence opt3 from VP1__Norovirus__BAS30110

SEQ ID NO: 18897 - RNA, 1623 nt, Artificial Sequence; identical to SEQ ID NO: 18261
  derived and/or modified sequence opt3 from VP1__Norovirus__BAS30113

SEQ ID NO: 18898 - RNA, 1623 nt, Artificial Sequence
  derived and/or modified sequence opt3 from VP1__Norovirus__BAS30116
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucgggacuacaccaugaaucucgcuagccugaacuggaauaacuaugauccgacggaagagauucccgccccucuugguacuccagacuucguagggaagauccagggaaugcugacacagaccacuaagggcgacggcucuacacgcgggcacaaggcuaccguuuacacgggauccgcccccuuuaccccuaaauuggguucagugcgauucagcacagauacugaaaaugacuuugagauccaucagaacaccaaguucacaccagucggcgugauucaagaugggaguacuacccacagaaaugaaccccagcaguggguccucccgucuuacuccggaagggacgcacacaacgugcaucuggccccugcuguugcgccaacauuucccggcgagcaauuacuguucuuucggagcaccaugccugguuguucgggguaucccaauauggaucucgacugccuucugccacaggagugggugcagcacuucuaccaggaagcagccccugcucaaucugauguagccuugcuacguuuugucaaccccgacacuggccgcgugcuguucgaguguaaacuccauaaguccggauauguuacgguggcacacacaggccagcacgaucuggucauaccaccgaauggguacuuuagauucgacucaugggugaaccaguucuauacccuugccccuaugggaaacgguacuggcaggcggcgagcucuguga

SEQ ID NO: 18899 - RNA, 1623 nt, Artificial Sequence; identical to SEQ ID NO: 18868
  derived and/or modified sequence opt3 from VP1__Norovirus__BAS30119

SEQ ID NO: 18900 - RNA, 1623 nt, Artificial Sequence
  derived and/or modified sequence opt3 from VP1__Norovirus__BAS30125
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucgggacuacaccaugaaucucgcuagccugaacuggaauaacuaugauccgacggaagagauucccgccccucuugguacuccagacuucguagggaagauccagggaaugcugacacagaccacuaagggcgacggcucuacacgcgggcacaaggcuaccguuuacacgggauccgcccccuuuaccccuaaauuggguucagugcgauucagcacagauacugaaaaugacuuugagauccaucagaacaccaaguucacaccagucggcgugauucaagaugggaguacuacccacagaaaugaaccccagcaguggguccucccgucuuacuccggaagggacgcacacaacgugcaucuggccccugcuguugcgccaacauuucccggcgagcaauuacuguucuuucggagcaccaugccugguuguucgggguaucccaauauggaucucgacugccuucugccacaggagugggugcagcacuucuaccaggaagcagccccugcucaaucugauguagccuugcuacguuuugucaaccccgacacuggccgcgugcuguucgaguguaaacuccauaaguccggauauguuacgguggcacacacaggccagcacgaucuggucauaccaccgaauggguacuuuagauucgacucaugggugaaccaguucuauacccuugccccuaugggaaacgguacuggcaggcggcgaguacuguga

SEQ ID NO: 18901 - RNA, 1623 nt, Artificial Sequence; identical to SEQ ID NO: 18261
  derived and/or modified sequence opt3 from VP1__Norovirus__BAS30128

SEQ ID NO: 18902 - RNA, 1623 nt, Artificial Sequence
  derived and/or modified sequence opt3 from VP1__Norovirus__BAS30134
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguccucccgucuuacuccggaagagaugugccuaauguucaccuggcaccagccguggcucccaccuuuccuggcgagcaguuacuguucuuuaggagcacuaugcccgguuguucgggguauccaaacauggaccucgauugccuucugccucaggaguggguacagcauuucuaccaagaagcggcacccgcccagucugacgucgcuuugcuacgguuugugaauccagauacgggccguguucuguucgaguguaaacuccacaaguccggauaugugacagucgcccauaccggccagcacgaccuggugauuccgccuaacggguacuuucgcuucgauucauggguaaaccaguucuauacucuugcacccaugggaaaugguaccggcagaaggcgggcccuguga

SEQ ID NO: 18903 - RNA, 1623 nt, Artificial Sequence; identical to SEQ ID NO: 18261
  derived and/or modified sequence opt3 from VP1__Norovirus__BAS30137

SEQ ID NO: 18904 - RNA, 1623 nt, Artificial Sequence; identical to SEQ ID NO: 18261
  derived and/or modified sequence opt3 from VP1__Norovirus__BAS30140

SEQ ID NO: 18905 - RNA, 1623 nt, Artificial Sequence
  derived and/or modified sequence opt3 from VP1__Norovirus__BAS30146
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgaucgagggccucucccccucucagguaacuauguucccucauauaaucguugacgugcgccaacuggagccaguccuuauuccccugccugaugugcgaaauaacuuuuaucacuacaaucagucgaacgacucaacgaucaaguugauugcuaugcucuauaccccacugcgugccaacaaugcgggggaagauguguucacagucagcugcagaguucugacuaggcccaguccggacuuugauuucaucuuucucgugccucccaccguagagucccggacaaaaccauucaccgugccuauauuaacugucgaagagaugacaaacucucgcuuucccauuccacuggagaaacuuuucaccggacccagcuccgccuucgugguucagccucagaaugguagauguacgacugacggcguguugcuggggaccacacaacuaucaccagucaacaucugcacuuuuaggggagaugugacccauauugcaggcagucacaauuacacaaugagccucgcuucucugaacuggaauaacuaugacccgaccgaagagauccccgccccucuugguacgccagauuucguagggaagauccagggaguucugacucagacaaccaagggcgacggcuccacucgggggcauaaggcuacaguguacaccggaucagcccccuuuacgccuaaauuggguagcguccaguucaguaccgacacagaaaaugauuuugagacucaccaaaacaccaaguucacaccagugggcgucauucaggacgggggaacuacccaccgcaaugaaccccagcaaugggugcucccgucuuacuccggccgaaacguuccuaaugugcaucuggcaccagccguagcucccacauuuccuggugagcaguuacuguucuuuagaagcaccaugcccggguguucgggcuauccaaacauggaucucgacugccuucugccucaggaguggguccagcacuucuaccaagaagcggcacccgcccagucugauguggcuuugcuaagguuuguuaauccagacacuggacgggugcuguucgaguguaaacuccauaaguccggcuaugucacgguggcccacacagggcagcacgaucugguaauaccgccuaacggauacuuucguuucgacucaugggugaaccaguucuauacccuugcacccauggguaauggcacugggcgcagaagggcccuguga

SEQ ID NO: 18906 - RNA, 1623 nt, Artificial Sequence
  derived and/or modified sequence opt3 from VP1__Norovirus__BAS30149
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaauguuccuaacgugcaccuggcaccagccguagcucccaccuuuccuggcgagcaguuacuguucuuuaggagcacuaugcccgguuguucgggguauccaaauauggaucucgacugccuucugccucaggaguggguccagcauuucuaccaagaagcggcacccgcccagucugauguggcuuugcuacgguuuguuaacccagacacgggccgugugcuguucgaguguaaacuccacaaguccggauaugucacaguggcccauaccggccagcacgaucugguaauuccgccuaacggguacuuucgcuucgacucaugggugaaucaguucuauacucuugcacccaugggaaacgguaccggcagaaggcgggcccuguga

SEQ ID NO: 18907 - RNA, 1623 nt, Artificial Sequence; identical to SEQ ID NO: 18261
  derived and/or modified sequence opt3 from VP1__Norovirus__BAS30152

SEQ ID NO: 18908 - RNA, 1623 nt, Artificial Sequence
  derived and/or modified sequence opt3 from VP1__Norovirus__BAS30155
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaagggcgaugugacacauaucgcagguucaaggaauuacaccaugaaccucgcuagucugaauuggaacaauuaugacccgacggaagagauucccgccccucuugggacuccagauuucguaggaaagauccagggcguucugacacagaccacuaagggcgacgggagcacacggggacacaaagcuaccguguacacggguucugcccccuuuaccccuaaguugggcuccguccaguucucaacagacacugaaaacgauuuugagacccaucaaaauacaaaauucacuccagugggggucauccaggacggaggcaccacacaccagaacgaaccccaacagugggugcucccgagcuacaguggucgcgauguuccuaaugugcaccuggcaccagccguagcucccaccuuuccuggggagcaguuacuguucuuucgaucuacuaugcccggcuguuccggauauccaaacaugaaucucgacugccuucugccucaggaguggguccaacauuucuaccaggaagcggcacccgcccagagcgauguggcuuugcuaagauuuguuaacccagacacgggcagggugcuguucgaguguaagcuccacaaaucgggguaugucacaguggcccauaccggacagcacgaucugguaauuccgccuaacgguuacuuucgguucgacucuugggugaaucaauucuauacucuugcacccaugggcaacgggaccggacgucgcagagcccuguga

SEQ ID NO: 18909 - RNA, 1623 nt, Artificial Sequence
  derived and/or modified sequence opt3 from VP1__Norovirus__BAS30158
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgaucgagggccucucccccucucagguaacuauguucccucauauaaucguugacgugcgccaacuggagccaguccuuauuccccugccugaugugcgaaauaacuuuuaucacuacaaucaguugaacgacucgacgaucaagcucauugcuaugcuguauaccccacugcgugccaacaaugcgggggaagauguguucacagucucaugcagaguucucacuaggcccagcccggacuuugauuucaucuuuuuagugccucccaccguagagagucggacaaaaccauucaccgugccuauacugacugucgaagagaugacaaacucccgcuuucccauuccacuugagaaguuguucaccggacccucuagcgccuucgugguucagccucagaaugguagauguacgacugacggcgugcugcuagggaccacacaacucuccccagucaacaucugcacuuuuaggggagaugugacccauauugcaggcucacggaauuacacaaugagucuggcuagccuuaacuggaauaacuaugacccgaccgaagagauccccgccccucuggguacgccagauuucguagggaaaauccagggaguuuugacucagacaaccaagggcgacggcucuacucgcgggcacaaggcuacaguguacaccggauccgcccccuuuacgccuaaacucgguucaguccaguucagcaccgacacagaaaaugauuuugagacucaucaaaacaccaaguucacaccagugggcgucauucaggacgggggaacuacccaccgaaaugaaccccagcaaugggugcugccgaguuacucuggcagaaacguuccuaaugugcacuuagcaccagccguagcucccacauuuccuggugagcagcuccucuucuuuagguccaccaugcccggguguagcggcuauccaaacauggaucuugacugccuguugccucaggaguggguccagcauuucuaccaagaagcggcacccgcccagucggauguggcucuacugcgguuuguuaauccagacacuggacgugugcuguucgaguguaaacugcacaagucuggcuaugucacgguggcccauacagggcagcacgaucuuguaauaccgccuaacggauacuuucgcuucgacuccugggugaaccaguucuauacccuggcacccauggguaauggcacugggagaaggcgggccuuguga

SEQ ID NO: 18910 - RNA, 1623 nt, Artificial Sequence
  derived and/or modified sequence opt3 from VP1__Norovirus__BAS30164
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgaucgagggccucucccccucucagguaacuauguucccucauauaaucguugacgugcgccaacuggagccaguccuuauuccccugccugaugugcgaaauaacuuuuaucacuacaaucagucgaacgacucaacgaucaaguugauugcuaugcucuauaccccacugcgugccaacaaugcgggggaagauguguucacagucagcugcagaguucugacuaggcccaguccggacuuugauuucaucuuucucgugccucccaccguagagucccggacaaaaccauucaccgugccuauauuaacugucgaagagaugacaaacucucgcuuucccauuccacuggagaaacuuuucaccggacccagcuccgccuucgugguucagccucagaaugguagauguacgacugacggcguguugcuggggaccacacaacuaucaccagucaacaucugcacuuuuaggggagaugugacccauauugcaggcagucggaauuacacaaugagccucgcuucucugaacuggaauaacuaugacccgaccgaagagauccccgccccucuugguacgccagauuucguagggaagauccagggaguucugacucagacaaccaagggcgacggcuccacucgcgggcacaaggcuacaguguacaccggaucagcccccuuuacgccuaaauuggguagcguccaguucaguaccgacacagaaaaugauuuugagacucaucaaaacaccaaguucacaccagugggcgucauucaggacgggggaacuacccaccgaaaugaaccccagcaaugggugcucccgucuuacuccggcagaaacguuccuaaugugcaccuggcaccagccguagcucccacauuuccuggugagcaguuacuguucuuuaggagcaccaugcccggguguucgggcuauccaaacauggaucucgacugccuucugccucaggaguggguccagcauuucuaccaagaagcggcacccgcccagucugauguggcuuugcuacgguuuguuaauccagacacuggacgugugcuguucgaguguaaacuccacaaguccggcuaugucacgguggcccauacagggcagcacgaucugguaauaccgccuaacggauacuuucgcuucgacucaugggugaaccaguucuauacccuugcacccauggguaauggcacugggagaaggcgggcccuguga

SEQ ID NO: 18911 - RNA, 1623 nt, Artificial Sequence; identical to SEQ ID NO: 18906
  derived and/or modified sequence opt3 from VP1__Norovirus__BAS30167

SEQ ID NO: 18912 - RNA, 1623 nt, Artificial Sequence; identical to SEQ ID NO: 18261
  derived and/or modified sequence opt3 from VP1__Norovirus__BAS30170

SEQ ID NO: 18913 - RNA, 1623 nt, Artificial Sequence
  derived and/or modified sequence opt3 from VP1__Norovirus__BAS30173
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagucuggcuaugucacaguggcccauaccgggcaguacgaucugguaauuccgccuaacggauauuuucgcuucgacuccugggugaaucaguucuacacucuugcacccauggguaacggcaccgggagaaggcgggcccuguga

SEQ ID NO: 18914 - RNA, 1623 nt, Artificial Sequence
  derived and/or modified sequence opt3 from VP1__Norovirus__BAS30176
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagacacuuuggagugcuccucugggaccagauuugaaucccuacuuaagccaccuggcccggauguauaacggcuacgcggguggguucgaagugcaggucauccuagcaggaaaugccuuuacugcuggcaaaauuaucuucgccgcagugccuccaaacuuuccgacggagggccucucccccucucagguaaccauguucccucauauuaucguugacgugcgccaacuggagccaguccuuauaccccugccugaugugcgaaauaacuuuuaucacuacaaucagucgaacgacucaacaaucaaguugauugcuaugcucuauacuccacugcgugccaacaaugcgggggaagauguguucaccgucagcugcagaguucugacaaggcccaguccggacuuugauuucaucuuucucgugccucccaccguagagucccggacuaaaccauucacagugccuauuuuaaccgucgaagagaugacgaacucucgcuuucccaucccacuggagaaacuuuucacuggacccagcuccgccuucgugguucagccucagaaugguagauguaccacagacggcguguugcuggggacuacccaacuaucaccagucaacauaugcacauuuaggggagaugugacccauauugcaggcagucggaauuacacgaugaaccucgcuagccugaauuggaacaauuaugacccgacugaagagauccccgccccucuugguacaccagauuucguagggaagauucagggaaugcugacccagacuacaaagggcgacggcucuacccgcgggcacaaggcuacgguuuacaccggauccgcccccuuuacaccuaaauuggguucagugcaguucagcacugacaccgaaaacgauuuugagacacaucaaaauacuaaguucaccccagucggcgugauccaggacgggaguacaacccaccgaaacgaaccccagcaauggguccucccgucuuacuccggaagaaaugugccuaacguucaccuggcaccagccguggcucccacuuuuccuggcgagcaguuacuguucuuuaggagcacgaugcccgguuguucgggguauccaaauauggaucucgacugccuucugccucaggaguggguacagcauuucuaccaagaagcggcacccgcccagucugaugucgcuuugcuacgguuugugaacccagacacaggccguguucuguucgaguguaaacuccacaaguccggauaugugaccgucgcccauacuggccagcacgaucuggugaucccgccuaacggguacuuucgcuucgacucauggguaaaucaguucuauacccuugcacccaugggaaacgguacaggcagaaggcgggcccuguga

SEQ ID NO: 18915 - RNA, 1623 nt, Artificial Sequence
  derived and/or modified sequence opt3 from VP1__Norovirus__BAS30179
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaagcuguucacgggacccagcuccgccuucgugguucagccucagaaugguagauguacuaccgacggcuugcugcuagggacaacucaacucucaccagugaacauuugcaccuuuaggggagaugucacacauaucgcaggcagucggaauuacaccaugaaccuggcuagccuuaauuggaacaauuaugacccgacggaagagauucccgccccucuggguacuccagauuucguggggaaaauccagggaauguugacacagaccacuaagggcgacggcucuacacgcgggcacaaggcuaccguauacacgggauccgcccccuuuaccccuaaacucgguucaguucaguucagcacagacacugaaaacgauuuugagacccaucaaaauacaaaguucacuccagugggcgucauccaggacgggaguaccacacaccgaaacgaaccccagcaaugggugcugccgucuuacuccggaagaaaugucccuaacgugcacuuagcaccagccguugcucccaccuuuccuggcgagcagcuucucuucuuuaggagcacuaugcccgguuguucgggguauccaaauauggaucuugacugccuguugccucaggagugggugcagcauuucuaccaagaagcggcacccgcccagucugauguagcucuacugcgguuugucaacccagacacgggccguguucucuucgaguguaaacugcacaaguccggauaugugacaguggcccauaccggccagcacgaucuugucauuccgccuaacggguacuuucgcuucgacucaugggugaaucaguucuauacucuggcacccaugggaaacgguaccggcagaaggcgggccuuguga

SEQ ID NO: 18916 - RNA, 1623 nt, Artificial Sequence
  derived and/or modified sequence opt3 from VP1__Norovirus__BAS30182
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccgggacuacaccaugaaccucgcuucucugaauuggaacaauuaugauccgacggaagagauucccgccccucuugguacuccagacuucguagggaagauccagggaaugcugacacagaccacuaagggcgacggcuccacacgcgggcacaaggcuaccguuuacacgggaucagcccccuuuaccccuaaauuggguagcgugcaguucaguacagauacugaaaacgacuuugagacccaucaaaauacaaaguucacuccagucggcgugauccaggaugggucuaccacacaccgaaacgaaccccagcaauggguccucccguccuacagcggaagaaaugugccuaacguucaccuggcaccagccguggcucccaccuuuccuggcgagcaguuacuguucuuuaggucgacuaugcccgguuguucuggguauccaaauauggaccucgauugccuucugccucaggaguggguacagcauuucuaccaagaagcggcacccgcccaguccgacgucgcuuugcuacgguuugugaacccagauacgggccguguucuguucgaguguaaacuccacaagucaggauaugugacagucgcccauaccggccagcacgaccuggugauuccgccuaauggguacuuucgcuucgauaguuggguaaaccaguucuauacucuugcacccaugggaaacgguaccggcagaaggcgggcccuguga

SEQ ID NO: 18917 - RNA, 1623 nt, Artificial Sequence
  derived and/or modified sequence opt3 from VP1__Norovirus__BAS30185
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaaugcugacacagaccacuaagggcgacggcuccacacgcgggcacaaggcuaccguuuacacgggaucagcccccuuuaccccuaaauuggguagcgugcaguucaguacagacacugaaaaugauuuugagacccaucaaaacacaaaguucacuccagucggcgugauccaggacgggucuaccacacaccgaaaugaaccccagcaauggguccucccguccuacagcggaagaaacgugccuaauguucaccuggcaccagccguggcucccaccuuuccuggcgagcaguuacuguucuuuaggucgacuaugcccgguuguucuggguauccaaacauggaucucgacugccuucugccucaggaguggguacagcauuucuaccaagaagcggcacccgcccaguccgaugucgcuuugcuacgguuugugaauccagacacgggccguguucuguucgaguguaaacuccacaagucaggauaugugacagucgcccauaccggccagcacgaucuggugauuccgccuaacggguacuuucgcuucgacaguuggguaaaccaguucuauacucuugcacccaugggaaaugguaccggcagaaggcgggcccuguga

SEQ ID NO: 18918 - RNA, 1623 nt, Artificial Sequence
  derived and/or modified sequence opt3 from VP1__Norovirus__BAS30188
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaaugcugacacagaccacuaagggcgacggcuccacacgcgggcacaaggcuaccguuuacacgggaucagcccccuuuaccccuaaauuggguagcgugcaguucaguacagacacugaaaaugauuuugagacccaucaaaacacaaaguucacuccagucggcgugauccacgacgggucuaccacacaccgaaaugaaccccagcaguggguccucccguccuacagcggaagaaacgugccuaauguucaucuggcaccagccguggcucccaccuuuccuggcgagcaauuacuguucuuuaggucgacuaugcccgguuguucuggguauccaaacauggaucucgacugccuucugccucaggaguggguacagcacuucuaccaggaagcggcacccgcccaauccgaugucgcuuugcuacgguuugugaauccagacacgggccguguucuguucgaguguaaacuccauaagucaggauaugugacagucgcccacaccggccagcacgaucuggugauuccgccuaacggguacuuucgcuucgacaguuggguaaaccaguucuauacucuugcacccaugggaaaugguaccggcagaaggcgggcccuguga

SEQ ID NO: 18919 - RNA, 1623 nt, Artificial Sequence; identical to SEQ ID NO: 18871
  derived and/or modified sequence opt3 from VP1__Norovirus__BAS30191

SEQ ID NO: 18920 - RNA, 1623 nt, Artificial Sequence; identical to SEQ ID NO: 18871
  derived and/or modified sequence opt3 from VP1__Norovirus__BAS30194

SEQ ID NO: 18921 - RNA, 1623 nt, Artificial Sequence; identical to SEQ ID NO: 18871
  derived and/or modified sequence opt3 from VP1__Norovirus__BAS30197

SEQ ID NO: 18922 - RNA, 1623 nt, Artificial Sequence; identical to SEQ ID NO: 18871
  derived and/or modified sequence opt3 from VP1__Norovirus__BAS30200

SEQ ID NO: 18923 - RNA, 1623 nt, Artificial Sequence; identical to SEQ ID NO: 18871
  derived and/or modified sequence opt3 from VP1__Norovirus__BAS30203

SEQ ID NO: 18924 - RNA, 1623 nt, Artificial Sequence; identical to SEQ ID NO: 18871
  derived and/or modified sequence opt3 from VP1__Norovirus__BAS30206

SEQ ID NO: 18925 - RNA, 1623 nt, Artificial Sequence
  derived and/or modified sequence opt3 from VP1__Norovirus__BAS30209
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagguacccgccccucuugguacuccagauuucguugggaagauucagggagugcugacacagaccacuaagggcgacggcucuacacgcgggcacaaggcuaccgucuacacgggauccgcccccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguucucccgucuuacuccggaagagaugugccuaauguacaccuggcaccagccgucgcucccaccuuuccuggcgagcaguuacuguucuuuaggagcacuaugcccgguuguucgggguauccaaacauggaccucgauugccuucugccucaggagugggugcagcauuucuaccaagaagcggcacccgcccagucugacguugcuuugcuacgguuugugaauccagauacgggccguguccuguucgaguguaaacuccacaaguccggauaugugacaguagcccauaccggccagcacgaccuggugaucccgccuaacggguacuuucgcuucgauucauggguuaaccaguucuauacucuugcacccaugggaaaugguaccggcagaaggcgggcccuguga

SEQ ID NO: 18926 - RNA, 1623 nt, Artificial Sequence
  derived and/or modified sequence opt3 from VP1__Norovirus__BAS30212
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagagauguuccuaaugugcaccuggcaccagccguagcucccaccuuuccuggugagcaguuacuguucuuuagguccacuaugcccggguguagcggcuauccaaacauggaccucgauugccuucugccucaggaguggguccagcauuucuaccaagaagcggcacccgcccagucggacguggcuuugcuacgguuuguuaauccagauacgggacgugugcuguucgaguguaaacuccacaagucuggcuaugucacaguggcccauaccgggcagcacgaccugguaauuccgccuaacggauacuuucgcuucgauuccugggugaaccaguucuauacucuugcacccauggguaauggcaccgggagaaggcgggcccuguga

SEQ ID NO: 18927 - RNA, 1623 nt, Artificial Sequence
  derived and/or modified sequence opt3 from VP1__Norovirus__BAS30215
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguccucccgucuuacuccggaagaaaugugccuaacguucaccuggcaccagccguggcucccaccuuuccuggcgagcaguuacuguucuuuaggagcacuaugcccgguuguucgggguauccaaauauggaucucgacugccuucugccucaggaguggguacagcauuucuaccaagaagcggcacccgcccagucugaugucgcuuugcuacgguuugugaacccagacacgggccguguucuguucgaguguaaacuccacaaguccggauaugugacagucgcccauaccggccagcacgaucuggugauuccgccuaacggguacuuucgcuucgacucauggguaaaucaguucuauacucuugcacccaugggaaacgguaccggcagaaggcgggcccuguga

SEQ ID NO: 18928 - RNA, 1623 nt, Artificial Sequence; identical to SEQ ID NO: 18927
  derived and/or modified sequence opt3 from VP1__Norovirus__BAS30218

SEQ ID NO: 18929 - RNA, 1623 nt, Artificial Sequence
  derived and/or modified sequence opt3 from VP1__Norovirus__BAS30221
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagguucagggagugcugacacagaccacuaagggcgacggcuccacacgcgggcacaaggcuaccgucuacacgggaucagcccccuuuaccccuaaauuggguagcgugcaguucaguacagacacugaaaaugauuuugagacccaucaaaacacaaaguucacuccagucggcgugauccaggacgggucuaccacacaccgaaaugaaccccagcaauggguucucccguccuacagcggaagaaacgugccuaauguacaccuggcaccagccgucgcucccaccuuuccuggcgagcaguuacuguucuuuaggucgacuaugcccgguuguucuggguauccaaacauggaucucgacugccuucugccucaggagugggugcagcauuucuaccaagaagcggcacccgcccaguccgauguugcuuugcuacgguuugugaauccagacacgggccguguccuguucgaguguaaacuccacaagucaggauaugugacaguagcccauaccggccagcacgaucuggugaucccgccuaacggguacuuucgcuucgacaguuggguuaaccaguucuauacucuugcacccaugggaaaugguaccggcagaaggcgggcccuguga

SEQ ID NO: 18930 - RNA, 1623 nt, Artificial Sequence
  derived and/or modified sequence opt3 from VP1__Norovirus__BAS30224
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccugucuuaacaguggaagagaugaccaacucucgcuuucccaucccacuggagaaacuuuucacgggacccagcuccgccuucguugugcagccucagaaugguagauguacuaccgacggcgucuugcuggggacaacucaacuaucaccagugaacauaugcaccuuuaggggagauguaacacauauugcaggcagucggaauuacaccaugaaccucgcuagccugaauuggaacaauuaugacccgacggaagagauccccgccccucuugguacuccagauuucguugggaagauucagggaaugcugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaauguuccuaacgugcaccuggcaccagccguagcucccaccuuuccuggcgagcaguuacuguucuuuaggagcacuaugcccgguuguucgggguauccaaauauggaucucgacugccuucugccucaggaguggguccagcauuucuaccaagaagcggcacccgcccagucugauguggcuuugcuacgguuuguuaacccagacacgggccgugugcuguucgaguguaaacuccacaaguccggauaugucacaguggcccauaccggccagcacgaucugguaaucccgccuaacggguacuuucgcuucgacucaugggugaaucaguucuauacucuugcacccaugggaaacgguaccggcagaaggcgggcccuguga

SEQ ID NO: 18931 - RNA, 1623 nt, Artificial Sequence
  derived and/or modified sequence opt3 from VP1__Norovirus__BAS30227
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucgggccaaaccauucaccgugccuaucuuaacugucgaagagaugacaaauagccgcuuucccauaccacuggagaaacuuuucaccggacccuccucagcauucgugguucagccucagaacgguagauguacgacugacggcguguugcuggggaccacacaacuaaguccagucaauauuugcacuuuuaggggagaugugacccauaucgcuggcagccggaacuacacaaugaaucucgccucuccgaacuggaauaacuaugaccccaccgaagagauuccugcuccacuggguacgcccgauuucguagggaagauccagggaaugcuuacucagacaaccaagggcgacggcuccacucgcgggcacaaggccacaguuuacaccggaucagcaccuuuuacgccaaaacuggguagcgugcaguucaguaccgacacagaaaaugauuuugagacucaucaaaacaccaaguucacacccgucggcgugauccaggacgggucuacuacccaccgaaaugaaccgcagcaaugggucuugccuuccuacagcggaagaaacgugccaaauguucaccucgcccccgcuguggcgccuacauuucccggcgagcagcuguuauucuuuaggucgaccaugccagguuguucuggguauccuaacauggaucuggacugccuccuuccccaggaguggguacagcauuucuaccaagaagcagccccagcucaguccgaugucgcccuguugcgguuugugaauccggacacuggccguguucuauucgaguguaaacugcacaagucaggauaugugacggucgcacauacaggccagcacgaucucgugauuccucccaacggguacuuucgcuucgacaguuggguaaaccaguucuauacccuggccccaaugggaaaugguacuggcagaaggcgggcucuuuga

SEQ ID NO: 18932 - RNA, 1623 nt, Artificial Sequence
  derived and/or modified sequence opt3 from VP1__Norovirus__BAS30230
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacuccuacgcgggcgguuucgaagugcaggucauucuagcagggaaugccuuuacagcuggaaaaaucauuuucgccgcagugccuccaaacuuuccgacugagggccucucucccucgcagguaacgauguucccucauaucauaguugacgugcgccaacuggagccaguccuuaucccccugccugaugugcgaaauaacuuuuaucacuacaaucagucaaacgacagcaccauuaaguugaucgcuaugcucuauacaccacugcgugccaacaaugcgggcgaagauguguucacugucaguugcagaguucugaccaggcccuccccggacuuugauuucauuuuucucgugccucccacaguagagucucggaccaaaccauucacugugccuaucuuaacagucgaagagaugaccaacagccgcuuucccauaccacuggagaaacuuuucacggggcccuccucagccuucgugguucagccucagaauggaagauguacuaccgacgguguguugcugggcacaacucaacuaaguccagucaacauuugcaccuuuaggggagaugugacacauaucgcaagcucucggaauuacaccaugaaccucgcuucccugaauuggaacaauuaugacccgacggaagagauucccgccccucuugggacuccagauuucguaggcaagauccaggguaugcugacacagaccacuaagggggacggaucaacacgcggccacaaggcuaccguuuacacgggcagcgcccccuuuaccccuaaauuggggagugugcaguucucuacagacacugaaaacgauuuugagacccaucaaaauacaaaguucacuccagucggagugauccaggacgguuccaccacacaccgaaacgaaccccagcaauggguccucccgagcuacucgggcagaaaugugccuaacguucaccuggcaccagccguggcucccgcguuuccuggggagcaguuacuguucuuuaggucuaccaugcccggauguuccggcuauccaaauauggaucucgacugccuucugccucaggaguggguacagcauuucuaccaagaagcagcccccgcucagucagaugucgccuugcuacgguuugugaacccagacacuggucguguucuguucgaguguaaacuccacaagaguggguaugugacggucgcacauacaggccagcacgaucuggugauuccgccuaacggauacuuucgcuucgacagcuggguaaaucaguucuauacccuugcccccaugggcaacgggacuggaagaaggcgggcucuguga

SEQ ID NO: 18933 - RNA, 1623 nt, Artificial Sequence; identical to SEQ ID NO: 18261
  derived and/or modified sequence opt3 from VP1__Norovirus__BAS30233

SEQ ID NO: 18934 - RNA, 1623 nt, Artificial Sequence; identical to SEQ ID NO: 18927
  derived and/or modified sequence opt3 from VP1__Norovirus__BAS30236

SEQ ID NO: 18935 - RNA, 1623 nt, Artificial Sequence; identical to SEQ ID NO: 18927
  derived and/or modified sequence opt3 from VP1__Norovirus__BAS30239

SEQ ID NO: 18936 - RNA, 1623 nt, Artificial Sequence
  derived and/or modified sequence opt3 from VP1__Norovirus__BAS30242
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagguacccgccccucuugguacuccagauuucguugggaagauucagggagugcugacacagaccacuaagggcgacggcucuacacgcgggcacaaggcuaccgucuacacgggauccgcccccuuuaccccuaaauuggguucagugcaguucagcacagacacugaaaacgauuuugagacccaucaaaauacaaaguucacuccagucggcgugauccaggacgggggaaccacacaccgaaacgaaccccagcaauggguucucccgaguuacucuggcagagaugugccuaauguacaccuggcaccagccgucgcucccaccuuuccuggugagcaguuacuguucuuuagguccacuaugcccggguguagcggcuauccaaacauggaccucgauugccuucugccucaggagugggugcagcauuucuaccaagaagcggcacccgcccagucggacguugcuuugcuacgguuugugaauccagauacgggacguguccuguucgaguguaaacuccacaagucuggcuaugugacaguagcccauaccgggcagcacgaccuggugaucccgccuaacggauacuuucgcuucgauuccuggguuaaccaguucuauacucuugcacccauggguaauggcaccgggagaaggcgggcccuguga

SEQ ID NO: 18937 - RNA, 1620 nt, Artificial Sequence
  derived and/or modified sequence opt3 from VP1__Norovirus__BAS30245
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcaaucccuccaaacuuuccgacugagggccucucccccucucaggugacgauguucccucauauaguaguugacgugcgccaacuggagccaguccuuaucccccugccugaugugcgaaauaacuuuuaucacuacaaucagaccaaggaaucgacaauuaaauugguggcuaugcucuauacuccacugcgugccaacaacgcgggggacgaugucuucaccguuucaugcagagugcugacaaggcccagcccggacuuugauuucaucuuucucguaccucccaguguggagucccggaccaagccauucacugucccuauuuuaacaguggaagagaugaccaauucucgcuuucccaucccacuggagagacuuuucacgggacccagcuccgccuucguugugcagccucagaacgguagguguacuaccgacggcgucuugcuggggacaacucaacuaucaccagugaauauaugcaccuuucggggagauguaacacgcguuaguaccacgcauguguacgaaaugaaccucgcaagccagaauuggaacaauuaugacccgacugaggaaguccccgcuccucugggcacaccagauuucguggguaaaauucaggggguccuuacccagacuacacgaaccgacggaucuacgagagcccacaaggcuaccguguccacaggcgccgcagacuuuacucccaagcugggcucaaucagguucgagaccacaacuaaccgggauuuggaaacccaucaaaauacaaaauuuaccccuguuggggugauucaggacggagauaaccaccagaaugagccacaacaguggcgucuccccgguuacgccggccgcgacgcucacaacguacaucuggcgccggcagucgccccuacuuucccaggggagcaguuacuguuuuucagaagcacgaugcccggauguaguggcuacccuaauaugaaccucgauugccuucugccccaggaaugggugcaacacuuuuaucaggaggcugccccagcacagucugacguugccuugcuaagguucgugaauccugauacaggucggguccuguuugaauguaagcuccauaaauccggguaccugaccguggcucacacuggccccuaugaccuuguaaucccaccgaacggauacuuccgauuugauagcugggugaaccaguucuauacccuggccccuaugggcaaugggacaggacgcagaagggcauuguga

SEQ ID NO: 18938 - RNA, 1623 nt, Artificial Sequence
  derived and/or modified sequence opt3 from VP1__Norovirus__BAS30248
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaucguguacaccgggucagcugauuuugccccuaagcugggaagaguccaauucgcaacagacacugauaaugacuuuggugccaaucagaacaccaaauucacaccagugggcgucauucaggauggggacacugcucauaggaaugagccccaacaguggguguugccgagcuacaguggacggaacucucacaauguucaccucgcgccugcaguggccccaaccuuucccggcgaacagcuguuauucuuucguuccacaaugccugguuguagcggguaucccaacauggaucuggacugccuccuuccacaggaguggguacaauacuucuaucaggaagcugccccugcacagucggaugucgcccuguugcgcuuugugaaucccgacaccggcagaguucuauucgaguguaagcugcauaaaucuggauacgugacugucgcucacacgggccagcaugaucucgugauaccaccgaacggguauuuuagguucgacuccuggguaaaccaauucuacacacuggccccuaugggaaaugguaccggccggcgacgcgcacuuuga

SEQ ID NO: 18939 - RNA, 1623 nt, Artificial Sequence; identical to SEQ ID NO: 18202
  derived and/or modified sequence opt3 from VP1__Norovirus__BAS30251

SEQ ID NO: 18940 - RNA, 1626 nt, Artificial Sequence
  derived and/or modified sequence opt3 from VP1__Norovirus__BAS30254
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagcaagguuuccccaaucccccugaaaaaguuguuuacgggaccuucaagugcguucgugguccagccacagaacggucgcuguacuaccgauggcgugcuucuggggacaacucaacuaagcccgguaaauauaugcaccuucagaggagacguuacacauauucccggcucuaggaacuacaccaugaaucucgccucccagaacuggaacucauaugauccuacggaggagaucccagcaccccuggguacuccugacuuuguggggaagauucagggaguccuuacacagaccacucggacaaauggcagcacccgcggccacaaagcuacgguguacaccgggagugccgacuucucuccaaagcugggacgaguccaauuugcuacagauacugacaaugauuucgaaaccaaccagaauacaaaauuuacucccguggguguuauccaggacggcuccaccacaccgagaaacgagccucaacaguggguguugccaagcuacucggggaggaauauccauaacguacaccucgcccccgcagucgccccuaccuuccccggagaacagcuguuauuuuuccggucuacuaugccaggcuguuccgguuauccuaauauggaucuggacugccuccuuccccaggagugggugcaauacuuuuaucaggaagcugcgccagcacagucagauguugcccuguugcguuucgugaacccggacacggggcgcguccuauuugaguguaagcugcacaaaaguggcuacgugacaguagcucauaccggacagcacgaucucgugauuccucccaacggcuauuucagauuugacagcuggguuaaucaauucuacacucuggccccaauggggaacggaaccgguaggcggcgagcacuuuga

SEQ ID NO: 18941 - RNA, 1623 nt, Artificial Sequence; identical to SEQ ID NO: 18225
  derived and/or modified sequence opt3 from VP1__Norovirus__BAS30257

SEQ ID NO: 18942 - RNA, 1623 nt, Artificial Sequence; identical to SEQ ID NO: 17702
  derived and/or modified sequence opt3 from VP1__Norovirus__BAS30260

SEQ ID NO: 18943 - RNA, 1623 nt, Artificial Sequence
  derived and/or modified sequence opt3 from VP1__Norovirus__BAS30263
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucugagacuaaaccauucuuuuucccuguguuaacagucgaagagaugaccaauagccgguuccccaucccacuggagaaacuuuuuacgggacccuccucagcguucgugguucagccucagaacggucgcuguacuaccgauggcguguugcuggggacaacucaacuaaguccagucaauauaugcaccuuuagaggagacgugacacauauuccgggcagcaggaacuacaccaugaaucucgccucucagaacuggaacuccuaugaucccacggaagagaucccugcaccacuggguacucccgacuucguagggaagauucagggaguucuuacacagaccacucggacaaauggcucaacccgcggccacaaggcuacgguguacaccgggagcgccgacuuuaguccuaagcugggacgaguccaauucgcuacagauacugacaaugauuuugaaaccaaccagaauacaaaauucacuccagugggugucauccaggacggcucuaccacacccagaaacgagccgcaacaguggguguugccuuccuacagcgggaggaauauccauaacguucaccucgccccagcaguggcccccaccuuuccuggagaacagcuguuauucuuucggucgacuaugcccggcuguucugguuauccaaauauggaucuggacugccuccuuccucaggaguggguacaauacuucuaucaggaggcugcgcccgcacaguccgaugucgcccuguugcguuuugugaacccagacacggggcgcguucuauucgaauguaagcugcacaaaucaggcuacgugacagucgcucauaccggacagcacgaucucgugauuccgccuaacggcuauuucagauuugacaguuggguaaaucaauucuacacucuggcccccauggggaacggaaccgguaggcggcgagcacuuuga

SEQ ID NO: 18944 - RNA, 1623 nt, Artificial Sequence; identical to SEQ ID NO: 18225
  derived and/or modified sequence opt3 from VP1__Norovirus__BAS30266

SEQ ID NO: 18945 - RNA, 1623 nt, Artificial Sequence; identical to SEQ ID NO: 18225
  derived and/or modified sequence opt3 from VP1__Norovirus__BAS30269

SEQ ID NO: 18946 - RNA, 1623 nt, Artificial Sequence; identical to SEQ ID NO: 18225
  derived and/or modified sequence opt3 from VP1__Norovirus__BAS30272

SEQ ID NO: 18947 - RNA, 1623 nt, Artificial Sequence
  derived and/or modified sequence opt3 from VP1__Norovirus__BAS30275
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuauucccucuggcucggaaagugaagggcuaugccgguggguuugaaguccaggugauucuagcgggaaaagcauucccagccggcaagaucauuuuugcugccagcccgcccaacuucccuacugagggccucuccccaucucagguaacgauguuuccccacaucauaguugacgugcgccaacuggagccuguccuuaucccacugcccgaugugcgaaauaacuucuaccauuauaaucagucgaacgacucaaccauuaaauugaucgcaaugcucuacacaccgcugcgugcuaauaacgccggggaagauguguuuacugucagcugcagaguucugaccaggccuagucccgacuucgauuuuauuuuccucgugccaccuacaguagagucccggaccaagcccuuuucugugccaaucuuaacugucgaagagaugacaaacagccgcuuccccauaccucuggagaaacuuuucaccggaccauccucaacguuugugguucagccgcagaaugguagauguacuaccgacggcguguugcuggggacaacucaacuaagucccgucaacauuugcaccuucaggggagaugugacacacaucgcgggcagccggaauuauaccaugaaccucgccucucagaauuggaacuccuacgacccuacggaagagauuccagcaccccuggguacuccugauuuuguagggaagauccagggaguucuuacacagaccacucgccgagacggcucaacaagaggccauaaggcuaccguguauacggggagcgccgacuucaguccaaaacugggaaggguccaauuugcuaccgauacagacaaugauuucgacacucaccagaacaccaaguuuacacccgugggugucauccaggauggcgggacugcccaucggaaugaaccgcaacaguggguguugccuucuuacuccggacguaacacccacaauguucaccucgcaccagccguggcucccacauucccuggcgagcagcuguuauuuuuccgcagcaccaugcccgguuguucgggguacccaaacauggaccuggauugccuccuuccucaggaauggguacaauauuuuuaccaggaggcggcacccgcccagucugacgucgcucuguugagauucgugaauccagauacuggcaggguucuauuugaguguaaacugcauaaguccggauaugugacggucgcccacacaggccagcaugaccucgugauuccgccuaacggguacuuccgguucgauucauggguaaaucaauuuuauacccuggcacccaugggaaacgguacuggccgacgcagagcccuuuga

SEQ ID NO: 18948 - RNA, 1623 nt, Artificial Sequence; identical to SEQ ID NO: 18225
  derived and/or modified sequence opt3 from VP1__Norovirus__BAS30278

SEQ ID NO: 18949 - RNA, 1623 nt, Artificial Sequence; identical to SEQ ID NO: 17698
  derived and/or modified sequence opt3 from VP1__Norovirus__BAS30284

SEQ ID NO: 18950 - RNA, 1623 nt, Artificial Sequence
  derived and/or modified sequence opt3 from VP1__Norovirus__BAS30287
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaccaaccagaauacaaaauucacucccgucggugugauccaggacggcucuaccacaccgaggaacgaaccucaacaguggguuuugccauccuacagcgggcggaauauccauaacgugcaccucgcccccgcaguagccccuaccuuucccggagagcagcuguuauucuuucguucgacuaugccaggcuguucugguuauccuaauauggaucuggacugccuccuuccccaggaauggguccaauacuucuaucaggaggcugcgccagcacaguccgauguggcccuguugcgcuuuguuaacccggacacggggagagugcuauucgaguguaagcugcacaaaucaggcuacgucacaguggcucauaccggacagcacgaucucguaauuccucccaacggcuauuuuagguucgacaguuggauaaaucaauucuacacucuggccccaauggggaacggaaccggucggcgacgcgcacuuuga

SEQ ID NO: 18951 - RNA, 1623 nt, Artificial Sequence
  derived and/or modified sequence opt3 from VP1__Norovirus__BAS30290
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugaauauaugcaccuuuaggggagacguaacacauauuucuggcucccggaacuacaccaugaaucucgccucacagaacuggaauagcuaugauccgacggaggaaauccccgcaccucuggguacuccagacuucguugggaagauucagggagugcuuacacagaccacucgcacaaacggcaguacccgaggccacaaggcuacggucuacaccgggucugccgacuuuucccccaagcugggaagagugcaauucgcuacagauacugacaaugauuuugagaccaaccagaauacaaaauucacuccugucggugugauccaggacggcagcaccacaccaaggaacgaaccccaacaguggguuuugccgucguacucugggcgguccauccauaaugugcaccucgccccugcaguagccccaaccuuucccggagagcagcuguuauucuuucguucaacuaugccuggcuguagugguuaucccaacauggaucuggacugccuccuuccacaggaauggguccaauacuucuaucaggaggcugcgccugcacagagcgauguggcccuguugcgcuuuguuaaucccgacacggggagagugcuauucgaguguaagcugcacaaauccggcuacgucacaguggcucauaccggacagcacgaucucguaauuccaccgaacggcuauuuuagguucgacucuugggugaaccaauucuacacucuggccccuauggggaauggaaccggucggcgacgcgcacuuuga

SEQ ID NO: 18952 - RNA, 1623 nt, Artificial Sequence
  derived and/or modified sequence opt3 from VP1__Norovirus__BAS30293
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucaacuuucgugguucagccacagaacgguagauguaccacagauggcguguugcuggggacuacccaacuaaguccggucaauauuugcacauuuaggggagacgugacccauaucgcgggcagccggaacuacacgaugaaucucgccucucagaacuggaacuccuaugaucccacugaggaaauuccugcaccacuggguacacccgacuucguagggaagauccagggaguucuuacccagacuacacgcaccgacggcucaacgcgaggccacaaggcuaccguguacacagggagcgccgauuuuaguccuaagcugggaagaguccaauucgcuacugacaccgauaaugacuuugaugccaaucagaacacaaaauucacuccagugggugucauccaggacggcgggaccgcacauaggaaugagccccaacaguggguguugccgucuuacuccggacggaacacacacaauguucaccucgccccugcuguggcgccaaccuuucccggcgaacagcuguuauucuuucguagcacuaugccugguuguucgggguaucccaacauggaucuggacugccuccuuccacaggaguggguacaauacuucuaucaggaagcagccccugcucagucugaugucgcccuguugcgcuuugugaaucccgacacgggcagaguucuauucgaguguaagcugcauaaauccggauacgcaacaguggcccacaccggccagcaugaucucgucauuccaccgaacggguauuuuagguucgacucaugggugaaccaauucuacacucuggcuccuaugggaaaugguaccggccggcgacgcgcccuuuga

SEQ ID NO: 18953 - RNA, 1623 nt, Artificial Sequence
  derived and/or modified sequence opt3 from VP1__Norovirus__BAS30296
augaagauggccagcaaccacgugaaucccuccgacggcucuaccgcuaaccuggucccugagguuaauaacgaagugauggcacucgagccaguagugggggccgcgaucgcugccccggucgcaggacagcaaaaugugauugaucccuggauaagaaacaauuucguucaggccccugguggcgaauuuacagugucaccaaggaacgcucccggggagauccuuuggagugcaccucugggaccagacuugaaucccuacuuaagccaucuggcccggauguauaacggcuacgcugguggguucgaaguccaggugauucuagccggaaaugcguuuacugcaggcaaaaucauuuucgccgcuguaccuccaaacuuuccgacggagggccucucccccucucagguuaccauguucccucacaucauaguggauguccgccaacuggagccagugcuuaucccccugccugacgugcgaaauaacuuuuaucauuacaaucagucgaacgauccaacaauuaaguugaucgccaugcucuauacuccccugcgugcaaacaaugcuggggacgaugucuucaccguuucaugcagagugcugacaaggccgagcccugacuuugauuucauuuuucucguacccccaaccguggaaagucggacuaaaccuuucuccguccccguguuaacaguugaggaaaugaccaacucucgcuuuccaaucccccuggagaaacuuuucacgggaccuagcuccgccuucgugguccagccacagaaugguagauguacuaccgacggcguguugcuggggacaacucaacuaucaccgguaaacauaugcaccuuuaggggagauguuacacacauucccggcagucggaauuacaccaugaaccucgcgagccagaauuggaacucuuaugacccuacggaggaaaucccagcaccccuggguacuccugauuucguggggaagauucagggaguccuuacacagaccacucgcacaaauggcuccacccgaggccauaaggccacgguguacaccgggucagcugacuuuagcccaaagcugggaagaguccaauucgccacagacacugauaacgacuuugagaccaaucagaacacaaaauucacucccguggguguuauccaggauggcaguaccacaccgaggaaugaaccucaacaguggguguugccaucuuacuccgggcggaacauccacaauguacaccucgcucccgccgucgcaccuaccuuucccggagagcagcuguuauucuuucguagcauuaugccaggcuguucggguuauccuaacauggaccuggauugccuccuuccccaggaaugggugcaauacuucuaucaggaggccgcuccagcgcagucugacguugcacuguugcgcuuugugaacccggauacugggagaguccuauucgaguguaagcugcauaaauccggcuacgugacgguagcccacacaggacagcaugaccucgugauaccucccaauggcuauuuuagguucgauucauggguuaaccaauucuacacccuggcuccaauggggaauggaacuggucggcgacgcgcccuuuga

SEQ ID NO: 18954 - RNA, 1623 nt, Artificial Sequence; identical to SEQ ID NO: 18203
  derived and/or modified sequence opt3 from VP1__Norovirus__BAS30299

SEQ ID NO: 18955 - RNA, 1623 nt, Artificial Sequence
  derived and/or modified sequence opt3 from VP1__Norovirus__BAS30302
augaagauggccagcuccgacgcuaaccccuucgauggcucuaccgcaaaucuggugccugaggucaacaaugaaguuauggcccucgagccagugguaggggcggcuaucgccgcaccgguggccggacagcaaaacgucauugaccccuggauaagaaauaacuuugugcaggcuccugguggcgaguucacaguuucaccaaggaaugcacccggggaaauccuuuggagugccccucugggaccagauuugaaccccuacuuaagccaccugucccggauguauaauggcuacgcugguggguuugaagugcaggucauucuagccggaaacgcguucacugcaggcaaaaucauuuuugccgcugugccuccaaauuucccgacggagggccucucucccucgcagguaaccauguuuccucauaucauaguugacgugcgccaacuggagccaguccuuaucccccugccugaugugcgaaacaauuucuaucacuacaaccagucaaaugacccaacaauuaaguugaucgccaugcucuauacuccccugcgugcaaacaacgcuggggaugacguguuuaccgucagcugcagaguucugacaaggccgaguccugauuucgacuuuauuuuccucgugcccccaaccguagaaucccggacuaaaccuuuuucugugcccgucuuaacaguggaggaaaugaccaauagccgcuucccaaucccccuggagaaacuuuucacgggaccuuccucagccuuuguugugcagccacagaacgguagauguacuaccgauggcgucuugcuggggacaacucaacuaaguccggugaauauaugcaccuucaggggagacguaacacauauucccggcagccggaacuacaccaugaaucucgcgucucagaacuggaacuccuaugauccuacggaggaaaucccagcaccccuggguacuccugacuuuguugggaagauucagggagugcuuacacagaccacucgcacaaauggcucaacccgaggccacaaggccacggucuacaccgggagcgcugacuucaguccaaagcugggaagagugcaauuugccacagauacugacaaugauuucgagaccaaccagaauacaaaauuuacucccgucggugugauccaggacggcucuaccacaccgaggaacgaaccucaacaguggguuuugccauccuacagcgggcggaauauccauaacgugcaccucgcucccgccguagcaccuaccuuccccggagagcagcuguuauuuuuccguucgacuaugccaggcuguucugguuauccuaauauggaucuggacugccuccuuccccaggaauggguccaauacuuuuaucaggaggccgcuccagcgcaguccgauguggcacuguugcgcuucguuaacccggacacggggagagugcuauuugaguguaagcugcacaaaucaggcuacgucacaguggcccauaccggacagcacgaucucguaauuccucccaacggcuauuucagguucgacaguugggugaaucaauuuuacacucuggcuccaauggggaacggaaccggucggcgacgcgcccuuuga

SEQ ID NO: 18956 - RNA, 1623 nt, Artificial Sequence
  derived and/or modified sequence opt3 from VP1__Norovirus__BAS30305
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcggaacucugggcccugauuugaacccauacuuaucccaccuggcccggauguauaaugguuacgcugggggauucgaagugcaggucauucuagccggcaacgcguuuacggcaggcaaaaucauuuucgccgcugugcccccuaauuuuccaaccgaggggcucucuccgucgcagguaacaauguucccccauaucauaguugacgugcgccaacuggagccuguccuuaucccacugcccgaugugcgaaacaauuuuuaucacuacaaccagucaaaugacccuacuauuaaguugaucgccaugcucuauaccccacugcgugcaaacaacgcuggagaugacguguucacagucagcugcagaguucugaccaggcccaguccggauuuugacuucauuuuucucgugccucccacuguagaaucccggacaaaaccauucucugugccugucuuaaccguggaggaaaugacgaauagccgcuuucccaucccacuggagaaacuuuucacuggucccuccucagccuucguugugcagccucagaacggcagauguaccacagauggggucuugcugggaacuacccaacuaaguccagugaauauaugcacauuuaggggcgacguaacccauauuccggguagccggaacuacacgaugaaucucgcgucucagaacuggaacuccuaugaucccacugaggaaaucccugccccacuggggacacccgacuucguuggaaagauucagggcgugcuuacccagacuacacgcaccaauggcucaacgcgagggcacaaggcaaccgucuacacaggaagcgcugacuuuaguccuaagcuggguagagugcaauucgccacugauaccgacaaugauuuugagacaaaccagaauacuaaauucaccccagucggcgugauccaggacgggucuacaacccccaggaacgaaccgcaacaguggguuuugccuuccuacagcggacggaauauccauaacgugcaccucgcuccagccguagcacccacuuuuccuggcgagcagcuguuauucuuucguucgacgaugcccgguuguucuggguauccaaauauggaucuggacugccuccuuccucaggaauggguccaauacuucuaucaggaggccgcucccgcgcaguccgauguggcacuguugcgcuuuguuaacccagacacaggcagagugcuauucgaguguaagcugcacaaaucaggauacgucaccguggcccauacuggccagcacgaucucguaauuccgccuaacggguauuuuagguucgacaguugggugaaucaauucuacacccuggcucccaugggaaacgguacaggccggcgacgcgcccuuuga

SEQ ID NO: 18957 - RNA, 1626 nt, Artificial Sequence
  derived and/or modified sequence opt3 from VP1__Norovirus__BAS30308
augaagauggccagcaacgacgugaaucccuccgauggcucuaccgcuaaccuggucccugagguuaauaacgaagugauggcacucgagccaguagugggggccgcgaucgcugccccggucgcaggacagcaaaaugugauugaccccuggauaagaaacaauuucguucaggccccugguggcgaauuuacagugucaccaaggaacgcucccggggagauccuuuggagugcaccucugggaccagauuugaaucccuacuuaagccaccuggcccggauguauaacggcuacgcugguggguucgaaguccaggugauucuagccggaaaugcguuuacugcaguaguucgcaucauuuucuccgccgugccuccaaacuuuccgacggagggccucucucccucgcaggucaccauguucccucauaucauaguggacgugcgacaacuggagccaguccuuaucccccugccugauguucguaauaacuuuuaucacuacaaucagucaaacgacagcacaauuaaauugaucgcuaugcucuauacuccacugagagccaacaaugcaggcgaugacguguucaccguaaguugcagggugcugacacggcccuccccggauuuugacuucauuuuucucgucccucccaccguggaaucucgcacuaagccauucagcguuccuguguuaacagucgaggaaaugaccaacuccagauuucccaucccacuggagaaacuuuucacggggcccucaagugcuuucgugguacagccucagaauggaagguguacuaccgaugguguuuugcugggcacaacucaacuaagcccagugaacauaugcaccuuucgcggggacgucacacauauuucuggaucccggaauuacaccaugaaccucgccucacagaauuggaacagcuaugauccgacggaggaaauccccgcgccucugggcacuccagacuucguggguaagauucaggggguccuuacacagaccacucgaacaaauggaaguaccagaggccacaaagccacgguguacaccggcucugcagacuuuucccccaagcuggggaggguucaauucgcuacagauacugacaacgauuuugagaccaaucagaacacaaaguucacuccugugggaguaauccaggacgguagcaccacaccacggaaugaaccccaacagugggucuugccgucguacucuggccguaacauccauaaugugcaccucgccccugcuguugccccaaccuuucccggggagcagcuguuauucuuucgcuccacuaugccuggauguucaggcuaucccaacauggaucuggacugccuccuuccacaggaaugggugcaauacuucuaucaggaggcagccccugcucagagugaugucgcgcuguugagauuugugaaccccgacacggguaggguacuauucgaguguaaacugcacaagagcggguacgugacaguugcacauaccggccagcacgaucucgucauuccaccgaauggauauuuucgguucgacuccugggugaaccaauucuacacucuggccccuaugggcaaugggaccggacgacgcagagcucuuuga

SEQ ID NO: 18958 - RNA, 1623 nt, Artificial Sequence; identical to SEQ ID NO: 17662
  derived and/or modified sequence opt3 from VP1__Norovirus__BAS30311

SEQ ID NO: 18959 - RNA, 1623 nt, Artificial Sequence
  derived and/or modified sequence opt3 from VP1__Norovirus__BAS30314
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauucccggcagccggaacuacaccaugaaucucgccucucagaacuggaacuccuaugauccuacggaggaaaucccagcaccccuggguacuccugacuucguugggaagauucagggagugcuuacacagaccacucgcacaaauggcucaacccgaggccacaaggcuacggucuacaccgggagcgccgacuuuaguccaaagcugggaagagugcaauucgcuacagauacugacaaugauuuugagaacaaucagaacaccaaauucacacccgucggugugauccaggacggcucuacuaccccgaggaaugaaccucaacaguggguuuugccauccuacagcgggcggaacauccauaaugugcaccucgcccccgcaguagccccuacauuucccggagagcagcuguuauucuuucguucgaccaugccaggcuguucugguuauccuaacauggaucuggacugccuccuuccccaggaauggguccaauacuucuaucaggaggcugcgccagcacaguccgauguggcccuguugcgcuuuguuaacccggacacugggagagugcuauucgaguguaagcugcacaaaucaggcuacgucacgguggcucauacaggacagcacgaucucguaauuccucccaauggcuauuuuagguucgacaguugggugaaccaauucuacacccuggccccaauggggaauggaacuggucggcgacgcgcacuuuga

SEQ ID NO: 18960 - RNA, 1623 nt, Artificial Sequence
  derived and/or modified sequence opt3 from VP1__Norovirus__BAS30317
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucaacuuucgugguucagccacagaacgguagauguaccacagauggcguguugcuggggacuacccaacuaaguccggucaauauuugcacauuuaggggagacgugacccauaucgcgggcagccggaacuacacgaugaaucucgccucucagaacuggaacuccuaugaucccacugaggaaauuccugcaccacuggguacacccgacuucguagggaagauccagggaguucuuacccagacuacacgcaccgacggcucaacgcgaggccacaaggcuaccguguacacagggagcgccgauuuuaguccuaagcugggaagaguccaauucgcuacugacaccgauaaugacuuugaugccaaucagaacacaaaauucacuccagugggugucauccaggacggcgggaccgcacauaggaaugagccccaacaguggguguugccgucuuacuccggacggaacacacacaauguucaccucgccccugcuguggcgccaaccuuucccggcgaacagcuguuauucuuucguagcacuaugccugguuguucgggguaucccaacauggaucuggacugccuccuuccacaggaguggguacaauacuucuaucaggaagcagccccugcucagucugaugucgcccuguugcgcuuugugaaucccgacacgggcagaguucuauucgaguguaagcugcauaaauccggauacgugacagucgcacacaccggccagcaugaucucgugauuccaccgaacggguauuuuagguucgacucauggguaaaccaauucuacacucuggccccuaugggaaaugguaccggccggcgacgcgcucuuuga

SEQ ID NO: 18961 - RNA, 1623 nt, Artificial Sequence; identical to SEQ ID NO: 18960
  derived and/or modified sequence opt3 from VP1__Norovirus__BAS30320

SEQ ID NO: 18962 - RNA, 1623 nt, Artificial Sequence
  derived and/or modified sequence opt3 from VP1__Norovirus__BAS30323
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuagcggcucucggaacuacaccaugaaucucgccucccagaacuggaacucauaugaucccacggaggaaaucccugcaccacuggguacucccgacuucguugggaagauucagggagugcuuacacagaccacucgcacaaauggcagcacccgaggccacaaggcuacggucuacaccgggagugccgacuuuucuccuaagcugggaagagugcaauucgcuacagauacugacaaugauuuugagaccaaccagaauacaaaauucacuccagucggugugauccaggacggcgggaccacacccaggaacgaaccgcaacaguggguuuugccuuccuacagcggacggaauauccauaacgugcaccucgccccagcaguagcccccaccuuuccuggcgagcagcuguuauucuuucguucgacuaugcccgguuguucuggguauccaaauauggaucuggacugccuccuuccucaggaauggguccaauacuucuaucaggaggcugcgcccgcacaguccgauguggcccuguugcgcuuuguuaacccagacacgggcagagugcuauucgaguguaagcugcacaaaucaggauacgucacaguggcucauaccggccagcacgaucucguaauuccgccuaacggguauuuuagguucgacaguugggugaaucaauucuacacucuggcccccaugggaaacgguaccggccggcgacgcgcacuuuga

SEQ ID NO: 18963 - RNA, 1623 nt, Artificial Sequence
  derived and/or modified sequence opt3 from VP1__Norovirus__BAS30326
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucucugcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacgggaccuucaaguacuuucgugguucagccacagaacgguagauguaccacagauggcguguugcuggggacuacccaacuaagcccggucaauauuugcacauuuaggggagacgugacccauaucacgggcucucacaacuacacuaugaaucucgccucccagaacuggaacucauaugaucccacagaggaaauuccugcgccacuggguacccccgacuucguagggaagauccagggaguucuuacucagacaacccggacggacggcagcacccgcggccauaaggccacaguguacacugggagugcagaguuuucuccuaagcugggacgaguccaauucgcuaccgauacaaauaaugacuuugaugccaaccagaauacuaaauucaccccagugggugucauccaggacggcgggacaacccacagaaacgaaccccaacaguggguguugccguccuacagcggaaggaauacucacaacguucaucucgcuccugccguggcaccaacguuucccggcgagcagcuguuauucuuucggucgacaaugccugguuguucuggguaucccaauauggaucuggacugccuccuuccacaggaauggguacaacacuucuaccaggaggccgcuccugcgcaguccgaugucgcacuguugcguuuugugaaccccgacaccggccgcguucuauucgaguguaagcugcauaaaucaggauaugugacugucgcccacaccggccagcacgaucucgugauuccaccgaacggguacuuuagauucgacaguuggguaaaucaauucuauacacuggcuccuaugggaaacgguaccggcaggcggcgagcccuuuga

SEQ ID NO: 18964 - RNA, 1623 nt, Artificial Sequence; identical to SEQ ID NO: 18225
  derived and/or modified sequence opt3 from VP1__Norovirus__BAS30329

SEQ ID NO: 18965 - RNA, 1623 nt, Artificial Sequence
  derived and/or modified sequence opt3 from VP1__Norovirus__BAS30332
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucucugcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaacgccccuggagaaacuuuucacuggaccuucaaguaccuucgugguucagccacagaacgguagauguacaacugauggcguguugcuggggaccacacaacuaagcccggucaauauaugcaccuuuaggggagacgugacgcauauuacuggcucucacaacuacacaaugaaucucgccucccagaacuggaacucauaugaucccaccgaggaaaucccugcgccacuggguacucccgacuucguagggaagauucagggaguucuuacacagaccacgcggaccgacggcagcacacgcggccauaaggccacuguguacaccgggagugcagaguuuucuccuaagcugggacgaguccaaguggcuacagauacuaauaaugacuucgaugccaaccagaauaccaaauuuacaccagucggugugauccaggacggcgggaccacucacagaaacgaaccccaacaguggguuuugccguccuacagcggaaggaaugcucacaacgugcaucucgccccugcaguagccccaacguuccccggcgagcagcuguuauuuuuccggucgacaaugccugguuguucuggguaucccaauauggaucuggacugccuccuuccacaggaauggguccaacacuuuuaccaggaggcugcgccugcacaguccgauguggcccuguugcguuucguuaaccccgacaccggccgcgugcuauuugaguguaagcugcauaaaucaggauaugucacuguggcucacaccggccagcacgaucucguaaucccaccgaacggguacuucagauuugacaguugggugaaucaauucuauacacuggccccuaugggaaacgguaccggcaggcggcgagcacuuuga

SEQ ID NO: 18966 - RNA, 1623 nt, Artificial Sequence
  derived and/or modified sequence opt3 from VP1__Norovirus__BAS30335
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcagccacaacuacaccaugaaucucgcaucucagaacuggaacuccuaugaucccacggaggaaauuccugcuccacuggguacucccgacuucguagggaagauccagggaguucuuacacagaccacucggacagacggcucaacccgcggccauaaggccacgguguacaccgggagcgcugaguuuaguccuaagcugggacgaguccaauucgccacagauacuaauaaugacuuugaugcaaaccagaauaccaaauucacaccagugggugucauccaggacggcgggacuacccacagaaacgaaccccaacaguggguguugccgucuuacuccggaaggaauacacacaacguucaucucgccccugcuguggcgccaaccuuucccggcgagcagcuguuauucuuucggagcacuaugccugguuguucgggguaucccaauauggaucuggacugccuccuuccacaggaauggguacaauacuucuaucaggaggcagccccugcucagucugaugucgcccuguugcguuuugugaaccccgacacgggccgcguucuauucgaguguaagcugcacaaauccggauacgugacagucgcacauaccggccagcacgaucucgugauuccaccgaacggguauuuuagauucgacucauggguaaaucaauucuacacucuggccccuaugggaaacgguaccggcaggcggcgagcucuuuga

SEQ ID NO: 18967 - RNA, 1623 nt, Artificial Sequence; identical to SEQ ID NO: 18202
  derived and/or modified sequence opt3 from VP1__Norovirus__BAS30338

SEQ ID NO: 18968 - RNA, 1623 nt, Artificial Sequence; identical to SEQ ID NO: 17702
  derived and/or modified sequence opt3 from VP1__Norovirus__BAS30341

SEQ ID NO: 18969 - RNA, 1623 nt, Artificial Sequence
  derived and/or modified sequence opt3 from VP1__Norovirus__BAS30344
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaucaauuucgugcaggcuccugguggcgaauuuacaguuaguccaaggaacgcacccggggagauucuuuggagcgccccucugggaccagauuugaaucccuacuuaucccaccuggcucggauguauaacggcuacgccgguggguucgaagugcaggucauccuagcgggaaaugcauuuacugccggcaaaauuaucuucgcugccgugccuccaaacuuuccgacggagggccucucucccucgcagguaaccauguucccucauauaaucguugacgugcgccaacuggagccaguccuuauuccccugccugaugugcgaaauaacuuuuaucacuacaaucagucaaacgacccaacaaucaaguugauugcaaugcucuauacuccccugcgugcuaauaacgccggggaugacguguucaccgucagcugcagaguucugacaaggccgaguccugauuuugacuucaucuuucucgugcccccaaccguagaaucccggacuaaaccuuucucugugcccgucuuaacaguggaggaaaugaccaacagccgcuuuccaauaccccuggagaaacuuuucacgggaccuuccucagcguucguugugcagccacagaaugguagauguacuaccgauggcgucuugcuggggacaacucaacuaaguccggugaacauuugcaccuuuaggggagacguaacacauauccccggcagccggaauuacaccaugaaccucgccucucagaauuggaacuccuaugauccuacggaggaaauuccagcaccccuggguacuccugacuucguugggaagauccagggagugcuuacacagaccacucgcacaaauggcucaacccgaggccacaaggcuacggucuacaccgggagcgccgacuuuaguccaaagcugggaagagugcaauucgcuacagauacugacaacgauuuugagaccaaucagaacacaaaauucacucccgucggugugauccaggacggcucuaccacaccgaggaaugaaccucaacaguggguuuugccauccuacagcgggcggaacauucauaaugugcaccucgcccccgcaguagccccuaccuuucccggagagcagcuguuauucuuucguucgacuaugccaggcuguucugguuauccuaacauggaucuggacugccuccuuccccaggaauggguccaauacuucuaucaggaggcugcgccagcacaguccgauguggcccuguugcgcuuuguuaauccggacacggggagagugcuauucgaguguaagcugcacaaaucaggcuacgucacaguggcucauaccggacagcacgaucucguaauaccucccaacggcuauuuuagguucgacaguugggugaaccaauucuacacucuggccccaauggggaauggaaccggucggcgacgcgcacuuuga

SEQ ID NO: 18970 - RNA, 1623 nt, Artificial Sequence; identical to SEQ ID NO: 17702
  derived and/or modified sequence opt3 from VP1__Norovirus__BAS30347

SEQ ID NO: 18971 - RNA, 1623 nt, Artificial Sequence; identical to SEQ ID NO: 17702
  derived and/or modified sequence opt3 from VP1__Norovirus__BAS30350

SEQ ID NO: 18972 - RNA, 1623 nt, Artificial Sequence
  derived and/or modified sequence opt3 from VP1__Norovirus__BAS30353
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccaguugaaugacccaacaauuaagcucaucgcaaugcuguauacuccccugcgugcuaacaacgccggggaugacguguucaccgucucaugcagaguucucacaaggccgagcccugauuuugacuucaucuuuuuagugcccccaaccguagaaagucggacuaaaccuuucuccgugcccguccugacaguggaggaaaugaccaauucucgcuuuccaauuccccuugagaaguuguucacgggaccuagcuccgcguucguugugcagccacagaacgguagauguacuaccgauggcguccugcuagggacaacucaacucucaccggugaauauaugcaccuuuaggggagacguaacacauauucccggcagucggaacuacaccaugaaucuggccagccagaacuggaacucuuaugauccuacggaggaaaucccagcaccccuugguacuccugacuucguugggaaaauucagggagugcugacacagaccacucgcacaaauggcuccacccgaggccacaaggcuacggucuacaccgggucagccgacuuuagcccaaaguugggaagagugcaauucgcuacagauacugacaaugauuuugagaccaaccagaauacaaaauucacucccgucggugugauccaggacggcaguaccacaccgaggaacgaaccucaacaguggguucucccaucuuacuccgggcggaauauccauaacgugcaccuggcccccgcaguagccccuaccuuucccggagagcaguuacuguucuuucguagcacuaugccaggcuguucggguuauccuaauauggaucucgacugccuucugccccaggaauggguccaauacuucuaucaggaggcugcgccagcacagucugauguggccuugcuacgcuuuguuaacccggacacggggagagugcuguucgaguguaagcuccacaaauccggcuacgucacaguggcucauaccggacagcacgaucugguaauuccucccaacggcuauuuuagguucgacucaugggugaaucaauucuacacucuugccccaauggggaacggaaccggucggcgacgcgcacuguga

SEQ ID NO: 18973 - RNA, 1623 nt, Artificial Sequence
  derived and/or modified sequence opt3 from VP1__Norovirus__BAS30356
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgaaccucugggaccagauuugaaccccuacuuaucccaccuggcccggauguauaauggcuacgcugguggguucgaggugcaggucauucuagccggaaacgcguuuacugcaggcaaaaucauuuucgccgcugugccuccaaauuuuccgacggagggccucucucccucgcagguaaccauguucccucauaucauaguugacgugcgccaacuggaaccaguccuuaucccccugccugaugugcgaaacaauuuuuaucacuacaaccagucaaaugacagcacaauuaaguugaucgccaugcucuauacuccacugcgugcaaacaacgcuggggaugacguguucaccgucaguugcagaguucugacaaggcccuccccggauuuugacuucauuuuucucgugccucccaccguagagucucggacuaaaccauucagcgugccugucuuaacaguggaagagaugaccaauucccgcuuucccaucccacuggagaaacuuuucacgggacccucaagugccuucguugugcagccucagaacgguagauguacuaccgauggcgucuugcuggggacaacucaacuaagcccagugaauauaugcaccuuuaggggagacguaacacauauuccgggcucucggaacuacaccaugaaucucgcgucccagaacuggaacucauaugaucccacggaagagaucccugccccacuggguacucccgacuucguugggaagauucagggagugcuuacacagaccacucgcacaaauggcagcacccgaggccacaaggcaacggucuacaccgggagugcugacuuuucuccuaagcugggaagagugcaauucgccacagauacugacaaugauuuugaaaccaaccagaauacaaaauucacuccagucggugugauccaggacggcgggaccacacauaggaacgagccccaacaguggguuuugccguccuacagcggacggaauauccacaacgugcaccucgcuccugccguagcaccaaccuuucccggcgaacagcuguuauucuuucguucgacuaugccugguuguucuggguaucccaauauggaucuggacugccuccuuccacaggaguggguccaauacuucuaucaggaggccgcuccugcgcaguccgauguggcacuguugcgcuuuguuaaccccgacacgggcagagugcuauucgaauguaagcugcauaaaucaggauacgucacaguggcccacaccggccagcaugaucucguaauuccaccgaacggguauuuuagguucgacaguugggugaaucaauucuacacucuggcuccuaugggaaacgguaccggccggcgacgcgcccuuuga

SEQ ID NO: 18974 - RNA, 1623 nt, Artificial Sequence; identical to SEQ ID NO: 18225
  derived and/or modified sequence opt3 from VP1__Norovirus__BAS30359

SEQ ID NO: 18975 - RNA, 1623 nt, Artificial Sequence; identical to SEQ ID NO: 17702
  derived and/or modified sequence opt3 from VP1__Norovirus__BAS30362

SEQ ID NO: 18976 - RNA, 1623 nt, Artificial Sequence; identical to SEQ ID NO: 17698
  derived and/or modified sequence opt3 from VP1__Norovirus__BAS30365

SEQ ID NO: 18977 - RNA, 1623 nt, Artificial Sequence; identical to SEQ ID NO: 17702
  derived and/or modified sequence opt3 from VP1__Norovirus__BAS30368

SEQ ID NO: 18978 - RNA, 1623 nt, Artificial Sequence; identical to SEQ ID NO: 17702
  derived and/or modified sequence opt3 from VP1__Norovirus__BAS30371

SEQ ID NO: 18979 - RNA, 1623 nt, Artificial Sequence
  derived and/or modified sequence opt3 from VP1__Norovirus__BAS30374
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaacacauauuaccggcagccggaacuacacgaugaaucucgccucucagaacuggaacuccuaugaucccacugaggaaaucccugcaccacuggguacacccgacuucguugggaagauucagggagugcuuacccagacuacacgcaccaauggcucaacgcgaggccacaaggcuaccgucuacacagggagcgccgacuuuaguccuaagcugggaagagugcaauucgcuacugauaccgacaaugauuuugaggccaaccagaauacaaaauucacuccagucggugugauccaggacggcucuaccacacccaggaacgaaccgcaacaguggguuuugccuuccuacagcgggcggaauauccauaacgugcaccucgcaccagccguagcucccaccuuuccuggagagcagcuguuauucuuucguucgacuaugcccggcuguucugguuauccaaauauggaucuggacugccuccuuccucaggaauggguccaauacuucuaucaggaggcggcacccgcccaguccgauguggcucuguugcgcuuuguuaacccagacacggggagagugcuauucgaguguaagcugcacaaaucaggcuacgucacaguggcccauaccggacagcacgaucucguaauuccgccuaacggcuauuuuagguucgacaguugggugaaucaauucuacacucuggcacccauggggaacggaaccggucggcgacgcgcccuuuga

SEQ ID NO: 18980 - RNA, 1623 nt, Artificial Sequence
  derived and/or modified sequence opt3 from VP1__Norovirus__BAU16297
augaagauggccagcaacgacgauaaucccuccgacggcucugcugcaaaccuggugccugaggucaauaacgaaguuauggcccucgagccagugguaggggcggcuaucgccgcaccgguggccggacagcaaaaugucauugaucccuggauaagaaacaauuucgugcaggcuccugguggcgaauuuaccguuucaccaaggaacgcacccggggagauccuuuggagugccccucugggaccagacuugaaucccuacuuaagccaccuggcucggauguauaacggcuacgccgguggguucgaagugcaggucauucuagcgggaaaugcauuuacagccggcaaagugaucuucgcugccguaccuccaaacuuuccgacugagggccucucccccucucagguuacgauguucccucauauuguggucgaugugcgccaacuggagccagugcuuaucccccugccugacguccgaaauaacuuuuaucacuacaaucagucgaacgauccaaccauaaaguugaucgcaaugcucuauacaccccugcgugcuaacaaugccggggacgauguuuucacugugucaugcagaguacugaccaggccgagcccugacuuugauuucauuuuucucgugcccccaacagucgaaagucggaccaaaccuuucuccgugcccguuuuaacuguggaggaaaugacaaacucucgcuuuccaaucccccuggagaaacuuuucaccggaccuagcuccgcguucgucgugcagccacagaaugguagauguacgacugacggcguauugcuggggaccacacaacuaucaccgguuaacauuugcacuuuuaggggagaugugacccauaucacaggcagucggaauuacaccaugaaccucgccagccagaauuggaacaauuaugaccccacggaggaaauaccugcaccacuggguacucccgacuucgucgggaagauucagggagugcuuacacagaccacucgcacagauggcucuacccgaggccacaaggcuacggucuacaccggguccgccgacuuugcuccuaagcugggaagagugcaauucgagacagauacugaccaugauuuugaagccaaccagaauaccaaauucacaccaguuggugugauccaggacggcgggacuacccacaggaacgagccccaacaguggguauugccgucauacagcggacgggauacacacaauguccaucucgccccugcaguggcuccaaccuuucccggcgaacagcuguuauucuuucguaguacuaugccugguuguucuggguaucccaacauggaccuggauugccuccuuccacaggaguggguucaauacuucuaucaggaggcggccccugcacaguccgacguggcucuguugcgcuuugucaaucccgauacgggcagagugcuauucgaauguaagcugcacaaaagcggauacguaacaguggcccauaccggccagcacgaccucguuauuccaccgaacggguauuuuagguucgacucgugggucaacaaguucuacacucuggcaccuaugggaaaugguaccggccggcgacgcgccguguga

SEQ ID NO: 18981 - RNA, 1623 nt, Artificial Sequence
  derived and/or modified sequence opt3 from VP1__Norovirus__BAU16299
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaauuaacuucgugcaagcaccaaauggggaauuuacuguaucucccaggaacucaccuggagagauccuguugaauuuagaacugggcccagaucuaaaccccuaccucgcccaccugagucggguguauaaugguuacgcugggggagucgaggugcagguucuucuggccggcaacgcguucacggcaggcaaaauuuuguuugccgcugugccuccaaauuucccggucgaguuucucagccccgcccagaucaccaugcugccucaucugauaguggacguacgcacacucgaaccaaucaugauucccuuaccugauguucgaaacacuuucuuucacuauuccaaucagccaaacucucguaugagacugguggcaaugcuuuacacccccuugaggucgaacgggucaggagacgaugucuucacagugagcugccgggugcugacccgcccgacuccugacuuugaguucacauaucuaguucccccaagugucgaauccaagaccaaaccuuuuucucuccccauccugacgcuuagcgagcugacuaauuccagauucccagugcccauugauucauuguuuaccgcucaugacaacguauggcaagugcagugucagaaugguaggugcacacucgauggcgagcugcaggggacuacccaauuacugccuacaggaaucugugccuuccggggccgcgucaccgcgcagauaaaccagcgagacagauggcacaugcagcuccaaaaucuuaacgguacgacuuacgauccaacagacgacgugccggcaccccuggggaccccugauuucaagggaguuguguuuggcauggucagucagaggaaugugggcaacgacgccccagggagcacucgggcucagcaagccuggguaucuacauauucaccccaguucguuccuaaauugggauccgugaaucuacguauuagcgauaacgacgauuuucaguuccagccaaccaaguuuacgcccgucggugugaaugacgaugacgauggccauccguuccgccaaugggaacugccuaacuacaguggggagcucacccugaauaugaaccuugcuccacccgucgccccuaauuuucccggagaacagcuguuguucuuuagaucuuucgugccaugcuccggcgguuacaaccaggggaucauugacugucucaucccucaggaguggauccaacacuuuuaucaggaaagcgcacccucgcagucugauguugcccugauuagguacgugaacccagacacaggccggacuuuauucgaggcuaagcugcaccgauccggauauauaaccguagcgcauucaggcgacuacccgcuagucgugccugcaaaugggcacuuucgcuucgauaguuggguuaaccaguucuauagccucgcccccauggagacaggaaaugguagaaggcgggcucaauga

SEQ ID NO: 18982 - RNA, 1635 nt, Artificial Sequence
  derived and/or modified sequence opt3 from VP1__Norovirus__BAU16301
augaugauggccagcaaggacgcugcacccuccgccgauggcgcgaccggggcuggacagcuggugccugaggucaacacagccgacccaaucccgauugaucccguugcagguucuucaacugcccucgcuacggcaggccaagugaaucuuauagacccuuggaucauuaacaauuucguacaggccccacagggggaauuuaccaucagucccaacaauacaccuggagaugugcuguucgacuugcaguuaggcccacaccugaaccccuuucuaagccaucucucccaaauguacaaugguugggucgggaacaugagagugaggguugugcuggcuggaaaugccuucacugcgggcaaagucauuaucugcugugugccuccaggcuuucagucucggacccuuucgauagcacaggccacacuguucccgcacguaaucgcugauguucgcaccuuggaccccguggaggucccucucgaagaugugcgaaacgugcuguaucauaauaacgacacucagccaacaaugcgucugcucugcauguuauacacgccccugagaaccgggggagccucagguggcacugauagcuuugucguugcagggagggugcuuaccuguccuggaccagacuucaacuuuuuguuccugguacccccgacaguggagcaaaagacucggccuuuuaccguccccaauauuccacuaaaauaucucaguaauucccgcaucccuaaccccauugaaggcaugucucugagcccagaucagacacagaacgugcaguuccaaaaugguagaugcaccaucgacgggcagccccuuggaacgacuccuguuuccgugucacagcuguguaaguuuaggggccggauaacaaguggccaaaaagucuugaaccucaccgagcuggacgggagcccauucauggcuuucgccgcgccggcccccgugggauuuccugauuuagguucuugcgacuggcacauugagauguccaagaucccaaauucaagcacucagaguaaccccauuguaguuaauucugugaagccuaacucccagcaguucgucccacaucugagcucgaucacacucgaugacaaugugucuuccggcggggauuacaucggaaccauucaauggacgucacccccgaguggcagcgguggggcaaacaccaauuuuuggaaaauaccugacuauggcuccucucuugcugaagccagccagcuggcuccagccgucuaucccccuggauucaacgaggugaucguuuacuuuauggcaucaauucccggcccaaaucagaguggguccccuaacuuggugcccugucuacugccacaggaauacaucacacacuucauaagcgagcaagccccgauucagggagaggcugcgcuccugcacuacguagauccugacacuaaucgcaaccuuggugaauuuaagcuguaucccggcggguacuugaccugcgucccaaauucuucaaguacaggaccccagcagcucccucuggauggcguguucguuuuugcaagcugggugucccgauucuaucaauuaaaaccagucgguacugccgggcccgcuagaggcaggcugggagugcggcguuga

SEQ ID NO: 18983 - RNA, 1623 nt, Artificial Sequence
  derived and/or modified sequence opt3 from VP1__Norovirus__BAU16303
augaugauggccagcaaggacgugcccaccuccccugauggcgcuucuggggcaggacagcuggucccagagguuaacacagccgaccaaaucucaauggauccgguggcgggugcuaguacugccguagcaacggccggccaggugaauaugauugaccccuggauauucaacaauuuuguccaggcuccucagggggaguucaccaucagcccaaacaauacacccggagauauucucuuugaccuucaacugggcccucacuugaacccauucuuagcacaucugucccagauguacaaugguuggguggggaacaugagaguuaggauccuacucgccggaaaugcuuuuacugccggcaaaauuaucauaugcugugugcccccuggcuucgaugcgcggauccugaccauugcacaggccacacuuuuuccacaccugaucgcugacguccgcaccuuggaaccgguggaacucccccuggaggauguacgaaacguucuguaucauaauucuucgcagccucaaccaacuaugcgucucguggccauguuauacacaccccugagaaccgggggagguucaggcgggacggacgcauucgucguggcuggaagggugcuuacuugcccugccccagauuuuagcuucuuguuucugguucccccgagugucgaacagaagacccggguguucuccguaccuaacauuccccuaaaagaccucucuaauagccgcgugccaacacugauccagggcauguuugucuccccugaugugaaccagucaguucaauuccagaaugguagaugucagauagacgggcaacuucagggaacuacccccgugagucugagccaguugugcaagauuaggggcaaaacaucuuccaacacccggguccucaaccugucagagguggacggcacgccauucguacccuuagagagcccugcgccaguuggguuuccggauaucggagguugugacuggcacgugggcuucacuuuugaagcccgcgaucaggggcccagucaaaaugucacauucgcaaccaacgacucuuccuuugugccuuaucugggaagcauuucgccacauaauggcgaugguuuccacucuggggacaucaucggcucccucgauuggauuucagcucccagugacggaagcgcccuugaugucugguccauaccuaaguacggcucuagccugccagacgugacucacuuggcucccgccguuuuuccgccuggguucggagaggugauccuauauuuucauucaaaguucccagguaguggccccacagauaaacugcgaguaccuugccucaugccccaggaauuuauuacccacuucugugacgagcaggcaccaaucgccggggaggcugcgcugcuucauuacgucgacccugaugcaggaagaaaccugggcgaauuuaaguuguaucccgacgguuucaugacgugcgugccaaauuccauaagcucugggccgcagacccucccuauuaacggcguuuucguguuugucucaugggugaguagguucuaccaacugaaacccguaggaacagccagcauggcucggcguuuaggccugcgcagaaucuga

SEQ ID NO: 18984 - RNA, 1647 nt, Artificial Sequence
  derived and/or modified sequence opt3 from VP1__Norovirus__BAU16305
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuaguaccgacaaucuuagcgcugcccagaucacaaugugcccacauguuauuguggauguccggcaacuggagccggugaacuugcccaugccugacguacgcaauaacuucuuucacuauaaccagggguccgauucucgacuccgucugaucgcgaugcuguacacuccacucagagccaauaacucgggagacgauguuuucaccgugucauguagggucuuaacacggcccagcccugacuuuaguuucaauuuucuggugccacccaccguggaauccaagacuaaaccguucacacuuccuauuuugaccaucucugagaugagcaacucccgcuuucccgucccaauagauucacugcauacgaguccuacugaaaauguugugguacagugccagaacgguagagugacccuagacggcgagcucauggggacaacucaacugcuucccagccagauuugugcauucaggggaguccugacccggucuacaucccgcgcuucagaucaggccgacaccgcugccccacgauuguucaauuauuacuggcacauccagcucgacaaccugaauggcacgcccuaugauccugcagaggacauuccagguccguuagggacucccgauuuuagaggaaagguguucggcguugccagccaaaggaacccugacaguacaacccgggcucaugaagcgaaaguggauacuacagcaggccguuuuaccccaaagcuggggucucucgagaucuccacggaaagcgacgauuucgaccagaaucagcccacccgcuuuacaccugucggaaucgguguggaucacgaggccgacuuccaacaguggucgcuuccagauuacucuggccaguuuacucacaacaugaaucuggcucccgccguagcaccgaacuucccuggggaacaguugcuauuuuucagaucccaacugccaucaaguggaggcaggagcaaugguauucucgacugccugguuccccaggagugggugcagcauuuuuaccaggaguccgccccugcucaaacccaggucgcccuugugcgguaugucaaccccgacacagggcgagugcuguucgaagcaaaguugcacaaacucggcuuuaugacuauagcgaagaacggagauucuccaaucauuguuccucccgacggcuacuuccgcuucgagagcugggugaauccauuuuauacccuggcuccgauggggaucggaaacgguagaaggcggauacaguga

SEQ ID NO: 18985 - RNA, 1671 nt, Artificial Sequence
  derived and/or modified sequence opt3 from VP1__Norovirus__BAU16306
augaagauggccagcuccgacgcugcacccucugccgauggcgcggggaaccuggugccugagucacagcaagaaguccucccacuugcuccgguugccggagcagcccuggcugcacccgugguaggucagaccaauaucauugacccuuggauaaaagagaacuucgugcaggccccacagggcgaauuuacagucagucccaagaauagcccuggggagaucuuggugaacuuagaacugggaccaaaacuaaaucccuaccucgaucaccuguccagaauguauaacucuuacgcuggcgguauugacguuauggugguccuugccgggaaugcguucacugcaggaaaggugcugaucgccgcuauuccuccaaacuuuccgguagagggcguuucggccucacaagcaacgcaguucccccaugugaucauagaugucaggaccuuggacccugugcggcucccacugcccgaugugcgcagcacauuuuuccacuauacuaaugacaccgagccuaaaaugcgacuggucaucuggcucuacacaccauuacguaccaacggcaguggggaugacuccuuuacuguuucuggaaggauucugacaagacccagccaggauuucgaauuugcuuuccuuaucccgccuaccguggagacgaagacuacccccuuuuccguaccagguuucucagugcaggaaaugaguaauagccgguggccugccgcgauuucugccauggucgugcgcggcaacgagccccaaguugugcaguuucagaaugggagagcacauuuggacggaaugcugcuaggcacaacuccagucucccccaacuauaucgcuucauacagggguauaagcaccgggaauagucggucugccuccccugaggcugaugaacgcgccgugggcagcuucgacguauggauucgacuccaggagccagacggacaaccguaugauaucuucggcaagcagcccgcaccuauugggacaccagacuuuaaagccguuaucgugggauucgcugcgagaccccugaccucggguucuuacgcaaacgaagccuacgucaacacgacugcuuccgauuaugccccugcaacaggcaauaugagguuuaccgugcggaacgggggaucaggccacaucagugccaauaaguacugggaguucaaauccuuuggugucgaaggggagcgucauacugacauucaguaucaagaguacgaacuuccagauuauagcggccagguggcuucuaaccacaaucuggcacccccgguugccccucgcaugccaggagagagcuugcuccuguuccagucaaacaugcccgugugggacgauggccacggggaaaguacaccuaagaaaauacauugcuuacugccccaggaguuuaucggacacuucuuugacaagcaagcgccaucccucggugaugcugcccuucugagauacguaaaucaggaaaccaacagggucuuguucgaguguaagcuauaucgggacggcuacauuacgguggcagccagcucugggcugcucgauuuuccucuggacggauucuuucgauucgacucauggguuaguagcuucuacauccuuucccccgugggcucuggucaggggcgcagaggcaggguccgguuucaguga

SEQ ID NO: 18986 - RNA, 1626 nt, Artificial Sequence
  derived and/or modified sequence opt3 from VP1__Norovirus__BAU16307
augaugauggccagcaaggacgcuacccccuccgcagauggcgccaacggggcgggacagcuggugccugaggucaauaacgcugaaccacucccgcuugaccccguugccggugcaucuacagcccuggcuacugcaggccaagugaauaugaucgauccuuggauuuucaacaauuuuguacaggccccacagggggaguucacgauaucacccaacaauaccccuggagacaucuuguuugauuuacagcugggcccacaccuaaaccccuuccucgcucaucugagucaaauguacaaugguuggguggggaacaugagagucagggugauucuugccggaaaugcguuuacagcaggcaaaguuaucauuugcugugugccuccaggcuuccagagccggacucuguccaucgcccaggcuaccuuguuuccgcacgucauagccgacgugcgcacacucgaaccccuggagaucccucuggaagauguacgaaacacccucuaucauaauaacgacucucagccaacuaugcguuuacugugcaugcuuuacacacccuugagaaccgggggagguucgggcgggacggaugcauucguuguggcuggaaggguccugacuuguccuucaccagacuuuaauuuccuauuucucgugcccccgaccguggagcaaaagacacggccuuucagcguccccaacauuccacugcagaaccuuaguaauucccgcguuccuucucugauccagagcaugguguuguccucagaucacgcccagacuguacaauuucagaacggcagaugcaccacagacggucaucuccuggggaccacgcccgugaguagcggacaguuaaugaaauucaggggcaaggucacuccaggcucuaaagugcugaaucucacagagcuugaugggucccccuuccuggcguuugaaccuccagccccggcaggauuccccgacuuggguaagugugacuggcacauugagaugucacuauaucaaguuaacaaucaggauaacccuaucgugcugcgggcuauagaaccaaauagcaguucuuuugucccccaccucggcuccgugagcuucaaccagaauguagacgccgcuggggauuacguuugcaccauucaguauacuucgccuccaucuaacucccaugacgccgauguggacuuuuggucaauccccgauuacggaaguaaucuggcagaggccagccaacuugcuccggucguguauccuccaggcuucggugaggcgauugucuacuuuaugucccgcgugcccggguggaaccgaacaaauagacugaacuugguuccuugucuccugccccaggaguucaucggccacuuugugucugaacaggcaccagccaucggagaagcugccuuacugcauuacguagacccugauaccaauaggaaccuaggcgaguucaagcucuaucccgaaggguuuauuacgugcgucccaaacggaaccgguccgcagcaacugccucuuaauggcguguucguuuuuagcucaugggugagucgguucuaccaguugaaacccgucgggacagcauccagcgcccguggacgccugggcauaagaagguga

SEQ ID NO: 18987 - RNA, 1623 nt, Artificial Sequence; identical to SEQ ID NO: 18313
  derived and/or modified sequence opt3 from VP1__Norovirus__BAU24831

SEQ ID NO: 18988 - RNA, 1623 nt, Artificial Sequence; identical to SEQ ID NO: 18265
  derived and/or modified sequence opt3 from VP1__Norovirus__BAU24834

SEQ ID NO: 18989 - RNA, 1623 nt, Artificial Sequence
  derived and/or modified sequence opt3 from VP1__Norovirus__BAU24837
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaucccacuggagaaacuuuucaccggacccucaagugccuucgucgugcagccucagaacgguagauguacgacugauggcguauugcuggggaccacacaacuaagcccaguuaauauuugcacuuuuaggggagacgugacccauaucacaggcucucggaacuacaccaugaaucucgcaucccagaacuggucaaauuaugauccgacggaggaaauacccgcuccucuggguacuccagacuucgucgggaagauucagggagugcuuacacagaccacucgcacagacggcagcacccgaggccacaaggccacggucuacaccgggagugcugauuuugugcccaagcugggaagaguucaauucgagacagacacugauagggacuuugaagccaaccagaauaccaaauucacaccuguggguguaauccaggauggcucuacuacccaucggaacgagccacaacagugggucuugcccuccuacagcgggcguaauacaccgaacgugcaccucgccccugcaguugcuccaaccuuucccggagaacagcuguuauucuuucgcucgacuaugccuggcuguucugguuaucccaauauggaccuggauugccuccuuccacaggagugggugcaauacuucuaucaggaggcggccccugcacaguccgacgucgcucuguugagauuugugaaccccgauacggggaggguacuauucgaauguaagcugcacaaaucaggcuacgugacaguugcccauaccggacagcacgaccucgucauuccaccgaauggcuauuuucgguucgauaguugggugaaccaauucuacacucuggcaccuauggggaacggaaccggucgacgcagagcccuuuga

SEQ ID NO: 18990 - RNA, 1623 nt, Artificial Sequence
  derived and/or modified sequence opt3 from VP1__Norovirus__BAU24840
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacucucaggggagacgugacccauaucacaggcagccggaacuacaccaugaaucuggcaucucagaacugguccaauuaugaucccacggaggaaauaccugcuccacuugguacucccgacuuugucgggaagauucagggagugcugacacagaccacucgcacagacggcucaacccgaggccacaaggccacggucuacaccgggagcgcugauuucgccccuaaguugggaagagugcaauuugagacagacacugauagggacuucgaagcaaaccagaauaccaaauuuacaccaguuggugugauccaggauggcaguacuacccaucggaacgagccccaacaguggguacucccgucuuacuccgggcguaauacaccuaacguccaccuggccccagcuguggcgcccaccuucccuggagaacaguuacuguuuuuccgcagcacuaugcccggcuguucggguuauccaaauauggaccucgauugccuucugccucaggaguggguucaauacuuuuaucaggaggcagcccccgcucagucugacguggccuugcuaagauucgucaacccagauacggggagggugcuguuugaauguaagcuccacaaauccggcuacguaacaguggcacauaccggacagcacgaccugguuauuccgccuaauggcuauuuccgguuugauucaugggucaaccaauucuacacucuugcccccauggggaacggaaccggucgacgcagagcucuguga

SEQ ID NO: 18991 - RNA, 1623 nt, Artificial Sequence; identical to SEQ ID NO: 18265
  derived and/or modified sequence opt3 from VP1__Norovirus__BAU24843

SEQ ID NO: 18992 - RNA, 1623 nt, Artificial Sequence
  derived and/or modified sequence opt3 from VP1__Norovirus__BAU24846
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucgaaacagacacugagaacgauuuugaaacccaucaaaauacaaaguucacuccagucggcgugauccaggacgggggaaccacacaccgaaacgagccccagcaauggguccucccgagcuacaguggcagaaaugugccuaacguucaccuggcaccagccguggcucccaccuuuccuggugagcaguuacuguucuuuaggucuauuaugcccggguguuccggcuauccaaauauggaucucgacugccuucugccucaggaauggguacagcauuucuaccaagaggcggcacccgcccagagcgaugucgcuuugcuacgguuugugaacccagacacuggacguguucuguucgaauguaaacuccacaagucgggcuaugugacggucgcccauacagggcagcacgaucuggugauaccgccuaacggauacuuucgcuucgacucuuggguaaaucaguucuauacccuugcacccauggguaacggcacugggagaaggcgggcccuguga

SEQ ID NO: 18993 - RNA, 1623 nt, Artificial Sequence; identical to SEQ ID NO: 18265
  derived and/or modified sequence opt3 from VP1__Norovirus__BAU24849

SEQ ID NO: 18994 - RNA, 1623 nt, Artificial Sequence
  derived and/or modified sequence opt3 from VP1__Norovirus__BAU24852
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugauagggacuuugaagcaaaucagaacaccaaauucacaccaguuggugugauccaggauggcagcacuacccaucggaaugagccccaacaguggguauugccgaguuacucugggcguaacacacacaauguccaccucgccccugcuguggcgccaaccuuucccggagaacagcuguuauucuuucgcuccacuaugccuggcuguagcgguuaucccaacauggaccuggauugccuccuuccacaggaguggguucaauacuucuaucaggaggcagccccugcucagucggacguggcccuguugagauuugucaaucccgauacggggagggugcuauucgaauguaagcugcauaaaucuggcuacguaacaguggcacacaccggacagcaugaccucguuauuccaccgaacggcuauuuucgguucgauuccugggucaaccaauucuacacucuggccccuauggggaauggaaccggucgacgcagagcuguguga

SEQ ID NO: 18995 - RNA, 1623 nt, Artificial Sequence; identical to SEQ ID NO: 18992
  derived and/or modified sequence opt3 from VP1__Norovirus__BAU24855

SEQ ID NO: 18996 - RNA, 1623 nt, Artificial Sequence; identical to SEQ ID NO: 18313
  derived and/or modified sequence opt3 from VP1__Norovirus__BAU24858

SEQ ID NO: 18997 - RNA, 1623 nt, Artificial Sequence
  derived and/or modified sequence opt3 from VP1__Norovirus__BAU24861
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucgaaacagacacugagaacgauuuugaaacccaucaaaauacaaaguucacuccagucggcgugauccaggacgggggaaccacacaccgaaacgagccccagcaauggguccucccgagcuacaguggcagaaaugugccuaacguucaccuggcaccagccguggcucccaccuuuccuggugagcaguuacuguucuuuaggucuacuaugcccggguguuccggcuauccaaauauggaucucgacugccuucugccucaggaauggguacagcauuucuaccaagaggcggcacccgcccagagcgaugucgcuuugcuacgguuugugaacccagacacgggacguguucuguucgaauguaaacuccacaagucgggcuaugugacagucgcccauaccgggcagcacgaucuggugauuccgccuaacggauacuuucgcuucgacucuuggguaaaucaguucuauacucuugcacccauggguaacggcaccgggagaaggcgggcccuguga

SEQ ID NO: 18998 - RNA, 1623 nt, Artificial Sequence; identical to SEQ ID NO: 18265
  derived and/or modified sequence opt3 from VP1__Norovirus__BAU24864

SEQ ID NO: 18999 - RNA, 1623 nt, Artificial Sequence
  derived and/or modified sequence opt3 from VP1__Norovirus__BAU24867
augaagauggccagcuccgacgcuaaccccaccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaagugaucuucgccgcaguaccuccaaauuuuccgacggagggccucucccccucucagguuaccauguucccucauauuguggucgacgugcgccaacuggagccagugcuuaucccccugccugauguccgaaacaauuuuuaucacuacaaccagucgaaugacccaacaauaaaguugaucgcuaugcucuauacuccccugcgugccaacaacgcgggggaugacguuuucaccgugucaugcagaguacugacaaggccgagcccugauuuugacuucauuuuucucgugcccccaaccgucgaaagucggacuaaaccuuucuccgugcccguuuuaacaguggaggaaaugaccaauucucgcuuuccaaucccccuggagaaacuuuucacgggaccuagcuccgccuucgucgugcagccacagaacgguagauguacuaccgauggcguauugcuggggacaacucaacuaucaccgguuaauauuugcaccuuuaggggagacgugacacauaucaccggcagucggaacuacacgaugaaucucgcaagccagaacuggucuaauuaugaucccacugaggaaauaccugcuccacuggguacacccgacuucgucgggaagauucagggagugcuuacccagacuacacgcaccgacggcuccacgcgaggccacaaggccaccgucuacacagggucagcugauuuugccccuaagcugggaagagugcaauucgagacugacaccgaucaugacuuugaagcaaaccagaauacaaaauucacuccaguuggugugauccaggauggcagcaccacacacaggaacgagccccaacaguggguauugccgaguuacucugggcggaauaccccuaacguccaccucgccccagcuguggcgcccacuuuuccuggagaacagcuguuauucuuucguuccacgaugcccggcuguagcgguuauccaaauauggaccuggauugccuccuuccucaggaguggguucaauacuucuaucaggaggcagcccccgcucagucggacguggcccuguugcgcuuugucaacccagauacagggagagugcuauucgaauguaagcugcauaaaucuggcuacguaaccguggcacacacuggacagcaugaccucguuauuccgccuaauggcuauuuuagguucgauuccugggucaaccaauucuacacccuggcccccauggggaacggaacaggucggcgacgcgcucuuuga

SEQ ID NO: 19000 - RNA, 1623 nt, Artificial Sequence; identical to SEQ ID NO: 18313
  derived and/or modified sequence opt3 from VP1__Norovirus__BAU24870

SEQ ID NO: 19001 - RNA, 1623 nt, Artificial Sequence; identical to SEQ ID NO: 18265
  derived and/or modified sequence opt3 from VP1__Norovirus__BAU24873

SEQ ID NO: 19002 - RNA, 1623 nt, Artificial Sequence; identical to SEQ ID NO: 18265
  derived and/or modified sequence opt3 from VP1__Norovirus__BAU24876

SEQ ID NO: 19003 - RNA, 1623 nt, Artificial Sequence; identical to SEQ ID NO: 18265
  derived and/or modified sequence opt3 from VP1__Norovirus__BAU24879

SEQ ID NO: 19004 - RNA, 1623 nt, Artificial Sequence
  derived and/or modified sequence opt3 from VP1__Norovirus__BAU24882
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaaaccaaucagaacacaaaauucacuccaguuggugugauccaggauggcgggaccacacacaggaaugagccccaacaguggguauugccgagcuacaguggacggaacaccccuaauguccaccucgcaccagccguggcucccacuuuuccuggcgaacagcuguuauucuuucguucuacgaugcccgguuguuccggguauccaaacauggaccuggauugccuccuuccucaggaguggguucaauacuucuaucaggaggcggcacccgcccagagcgacguggcucuguugcgcuuugucaauccagauacaggcagagugcuauucgaauguaagcugcauaaaucgggauacguaaccguggcccacacuggccagcaugaccucguuauuccgccuaacggguauuuuagguucgauucuugggucaaccaauucuacacccuggcacccaugggaaaugguacaggccggcgacgcgcccuuuga

SEQ ID NO: 19005 - RNA, 1623 nt, Artificial Sequence
  derived and/or modified sequence opt3 from VP1__Norovirus__BAU24885
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcgggacuacccacaggaaugagccccaacaguggguauugccgagcuacaguggacgggacacacacaacguccaucucgccccugcuguggcgccaaccuuucccggcgaacagcuguuauucuuucguucuacuaugccugguuguuccggguaucccaauauggaucuggacugccuccuuccacaggaguggguucaauacuucuaucaggaggcagccccugcucagagcgauguggcccuguugcgcuuugucaaccccgacacgggcagagugcuauucgaauguaagcugcacaaaucgggauacguaacaguggcacauaccggccagcacgaucucguuauuccaccgaauggguauuuuagguucgacucuugggucaaccaauucuacacucuggccccuaugggaaacgguaccggccggcgacgcgcuguguga

SEQ ID NO: 19006 - RNA, 1623 nt, Artificial Sequence; identical to SEQ ID NO: 18265
  derived and/or modified sequence opt3 from VP1__Norovirus__BAU24888

SEQ ID NO: 19007 - RNA, 1623 nt, Artificial Sequence
  derived and/or modified sequence opt3 from VP1__Norovirus__BAU24891
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucgcaacagacacugaaaacgauuuugagacccaucaaaauacaaaguucacuccagucggcgugauccaggacgggggaaccacacaccgaaacgaaccccagcaauggguccucccgagcuacaguggcagaaaugugccuaacguucaccuggccccagcuguggcgcccaccuuuccuggugagcaguuacuguucuuuaggucuacuaugcccggguguuccggcuauccaaauauggaucucgacugccuucugccucaggaguggguacagcauuucuaccaagaagcagcccccgcucagagcgaugucgccuugcuacgguuugugaacccagacacgggacguguucuguucgaguguaaacuccacaagucgggcuaugugacagucgcacauaccgggcagcacgaucuggugauuccgccuaacggauacuuucgcuucgacucuuggguaaaucaguucuauacucuugcccccauggguaacggcaccgggagaaggcgggcucuguga

SEQ ID NO: 19008 - RNA, 1623 nt, Artificial Sequence; identical to SEQ ID NO: 18313
  derived and/or modified sequence opt3 from VP1__Norovirus__BAU24894

SEQ ID NO: 19009 - RNA, 1623 nt, Artificial Sequence
  derived and/or modified sequence opt3 from VP1__Norovirus__BAU24897
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugugccuaagcugggaagaguucaauucgagacagacacugaucaugacuuugaagccaaccagaauaccaaauucacaccaguggguguaauccaggauggcaguacuacccacaggaacgagccccaacagugggucuugccgucuuacuccgggcggaauacaccuaacgugcaccucgcaccagccguugcucccaccuuuccuggagaacagcuguuauucuuucguagcacuaugcccggcuguucggguuauccaaauauggaccuggauugccuccuuccucaggagugggugcaauacuucuaucaggaggcggcacccgcccagucugacgucgcucuguugcgcuuugugaacccagauacggggagaguacuauucgaauguaagcugcauaaauccggcuacgugacaguugcccacaccggacagcaugaccucgucauuccgccuaauggcuauuuuagguucgauucaugggugaaccaauucuacacucuggcacccauggggaacggaaccggucggcgacgcgcccuuuga

SEQ ID NO: 19010 - RNA, 1623 nt, Artificial Sequence; identical to SEQ ID NO: 18265
  derived and/or modified sequence opt3 from VP1__Norovirus__BAU24900

SEQ ID NO: 19011 - RNA, 1623 nt, Artificial Sequence; identical to SEQ ID NO: 18265
  derived and/or modified sequence opt3 from VP1__Norovirus__BAU24903

SEQ ID NO: 19012 - RNA, 1623 nt, Artificial Sequence; identical to SEQ ID NO: 18553
  derived and/or modified sequence opt3 from VP1__Norovirus__BAU24906

SEQ ID NO: 19013 - RNA, 1623 nt, Artificial Sequence; identical to SEQ ID NO: 18265
  derived and/or modified sequence opt3 from VP1__Norovirus__BAU24909

SEQ ID NO: 19014 - RNA, 1623 nt, Artificial Sequence; identical to SEQ ID NO: 18313
  derived and/or modified sequence opt3 from VP1__Norovirus__BAU24912

SEQ ID NO: 19015 - RNA, 1623 nt, Artificial Sequence
  derived and/or modified sequence opt3 from VP1__Norovirus__BAU24915
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaguaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcuaauuuugccccuaagcugggaagagugcaauucgagacagauacugaccaugauuuugaagcaaaccagaauaccaaauucacaccaguuggugugauccaggacggcucuacuacccacaggaacgagccccaacaguggguauugccguccuacagcgggcggaauacaccuaacguccaccucgccccagcuguggcgcccaccuuuccuggagaacagcuguuauucuuucguucgacuaugcccggcuguucugguuauccaaauauggaucuggacugccuccuuccucaggaguggguucaauacuucuaucaggaggcagcccccgcucaguccgauguggcccuguugcgcuuugucaacccagacacggggagagugcuauucgaauguaagcugcauaaaucaggcuacguaacaguggcacacaccggacagcaugaucucguuauuccgccuaauggcuauuuuagguucgacaguugggucaaccaauucuacacucuggcccccauggggaacggaaccggucggcgacgcgcucuuuga

SEQ ID NO: 19016 - RNA, 1623 nt, Artificial Sequence; identical to SEQ ID NO: 18265
  derived and/or modified sequence opt3 from VP1__Norovirus__BAU24918

SEQ ID NO: 19017 - RNA, 1623 nt, Artificial Sequence; identical to SEQ ID NO: 18265
  derived and/or modified sequence opt3 from VP1__Norovirus__BAU24921

SEQ ID NO: 19018 - RNA, 1623 nt, Artificial Sequence; identical to SEQ ID NO: 18265
  derived and/or modified sequence opt3 from VP1__Norovirus__BAU24924

SEQ ID NO: 19019 - RNA, 1623 nt, Artificial Sequence
  derived and/or modified sequence opt3 from VP1__Norovirus__BAU24927
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcgggacuacccacaggaacgagccccaacaguggguauugccgaguuacucuggacggaauacaccuaacguccaccucgccccagcuguggcgcccaccuuuccuggcgaacagcuguuauucuuucguuccacuaugcccgguuguagcggguauccaaauauggagcuggacugccuccuuccucaggaguggguucaauacuucuaucaggaagcagcccccgcucagucggauguggcccuguugcgcuuugucaacccagacacgggcagagugcuauucgaguguaagcugcauaaaucuggauacguaacaguggcacacaccggccagcaugaucucguuauuccgccuaauggguauuuuagguucgacuccugggucaaccaauucuacacucuggcccccaugggaaacgguaccggccggcgacgcgcucuuuga

SEQ ID NO: 19020 - RNA, 1623 nt, Artificial Sequence
  derived and/or modified sequence opt3 from VP1__Norovirus__BAU24930
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucaucgaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuaucguggacguccgccaacuggagccagugcuuauaccccugccugaugugcgaaacaauuuuuaucacuacaaccagucaaaugacagcaccaucaaguugauugcuaugcucuauacaccacugcgugccaacaacgcgggggaugacgucuucacuguuaguugcagagugcugaccaggcccuccccggauuuugacuucaucuuucucguaccucccacaguggaaucucggaccaaaccauucagcgucccuguguuaacuguugaggaaaugacaaauucccgcuuucccauuccacuggagaaacuuuucaccggacccucaagugccuucgugguccagccucagaacgguagauguacgacugauggcguguugcuggggaccacacaacuaagcccaguaaauaucugcacuuuuaggggagacguuacccauauaacaggcucucggaacuacaccaugaaucucgcaucccagaacuggaauaacuaugauccgacggaggaaauucccgcuccucuggguacuccagacuucguggggaagauccagggaaugcuuacacagaccacucgcacagacggcucaacccgaggccacaaggccacggucuacaccgggagcgcugauuuugcccccaagcugggaagagugcaauucgagacagacacugaucaugacuuugaagcaaaucagaacaccaaauucacaccugucggugugauucaggauggcaguacuacccacaggaaugagccacaacaguggguuuugcccucuuacuccgggcggaacacacacaaugugcaucucgccccggcuguagcgccuaccuuuccaggagaacagcuguuauucuuucguagcacuaugcccggcuguucggguuauccuaacauggaccuggauugccuccuuccccaggaguggguccaauacuucuaucaggaggcagccccagcucagucugacguggcccuguugcgcuuuguuaauccugauacggggagagugcuauucgaauguaagcugcacaaauccggcuacgucacaguggcacauaccggacagcacgaccucguaauucccccaaacggcuauuuuagguucgauucaugggugaaccaauucuacacucuggccccgauggggaauggaaccggucggcgacgcguugucuga

SEQ ID NO: 19021 - RNA, 1623 nt, Artificial Sequence; identical to SEQ ID NO: 18225
  derived and/or modified sequence opt3 from VP1__Norovirus__BAU24933

SEQ ID NO: 19022 - RNA, 1623 nt, Artificial Sequence
  derived and/or modified sequence opt3 from VP1__Norovirus__BAU24936
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucggcacagacacugaaaacgauuuugagacccaucaaaauacaaaguucacuccagugggggucauccaggacggaggcaccacacaccgaaacgaaccccagcaaugggugcucccgagcuacagugguagaaauguuccuaacgugcaccuggcaccagccguagcucccaccuuuccuggggagcaguuacuguucuuuaggucuacuaugcccggcuguuccggauauccaaauauggaucucgacugccuucugccucaggaguggguccagcauuucuaccaagaagcggcacccgcccagagcgauguggcuuugcuacgguuuguuaacccagacacgggccgugugcuguucgaguguaaacuccacaagccgggguaugucacaguggcccauaccggacagcacgaucugguaauuccucccaacgguuacuuucgcuucgacucgugggugaaucaguucuauacucuugcaccaaugggcaacgggaccggaagaaggcgggcccuguga

SEQ ID NO: 19023 - RNA, 1623 nt, Artificial Sequence
  derived and/or modified sequence opt3 from VP1__Norovirus__BAU24942
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaacuccugcuccacuggguacacccgacuucgucgggaagauacagggagugcuuacccagacuacacgcaccgacggcucaacgcgaggccacaaggccaccgucuacacagggagcgcugauuuugccccuaagcugggaagagugcaauucgagacugacaccgauagggacuuugaagcaaaccagaauacaaaauucacuccaguuggugugauucaggauggcaguaccacacaucggaacgagccccaacaguggguauugccgucuuacuccgggcguaauaccccuaacguccaccucgccccagcuguggcgcccacuuuuccuggagaacagcuguuauucuuucgcagcacgaugcccggcuguucggguuauccaaauauggaccuggauugccuccuuccucaggaguggguucaauacuucuaucaggaggcagcccccgcucagucugacguggcccuguugagauuugucaacccagauacagggagggugcuauucgaauguaagcugcacaaauccggcuacguaaccguggcacauacuggacagcacgaccucguuaucccgccuaauggcuauuuucgguucgauucaugggucaaccaauucuacacccuggcccccauggggaacggaacaggucgacgcagagcucuuuga

SEQ ID NO: 19024 - RNA, 1623 nt, Artificial Sequence
  derived and/or modified sequence opt3 from VP1__Norovirus__BAU24945
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaacuccugcuccacuggguacacccgacuucgucgggaagauacagggagugcuuacccagacuacacgcaccgacggcucaacgcgaggccacaaggccaccgucuacacagggagcgcugauuuugccccuaagcugggaagagugcaauucgagacugacaccgaucaugacuuugaagcaaaccagaauacaaaauucacuccaguuggugugauucaggauggcaguaccacacacaggaacgagccccaacaguggguauugccgucuuacuccgggcggaauaccccuaacguccaccucgccccagcuguggcgcccacuuuuccuggagaacagcuguuauucuuucguagcacgaugcccggcuguucggguuauccaaauauggaccuggauugccuccuuccucaggaguggguucaauacuucuaucaggaggcagcccccgcucagucugacguggcccuguugcgcuuugucaacccagauacagggagagugcuauucgaauguaagcugcauaaauccggcuacguaaccguggcacacacuggacagcaugaccucguuaucccgccuaauggcuauuuuagguucgauucaugggucaaccaauucuacacccuggcccccauggggaacggaacaggucggcgacgcgcucuuuga

SEQ ID NO: 19025 - RNA, 1623 nt, Artificial Sequence
  derived and/or modified sequence opt3 from VP1__Norovirus__BAU24948
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugaucaugacuuugaagcaaaccagaauaccaaauucacaccaguuggugugauccaggauggcaguacugcccacaggaacgagccccaacaguggguauugccgucuuacuccgggcggaauaccccuaacguccaccucgcuccagcgguggcacccacauuuccuggagaacagcuguuauucuuucguagcaccaugcccggcuguucggguuauccaaauauggaccuggauugccuccuuccucaggaguggguucaauacuucuaucaggaggccgcucccgcccagucugacguggcacuguugcgcuuugucaacccagauacugggagagugcuauucgaauguaagcugcauaaauccggcuacguaacgguggcccacacaggacagcaugaccucguuauuccgccuaauggcuauuuuagguucgauucaugggucaaccaauucuacacccuggcucccauggggaacggaacuggucggcgacgcgcccuuuga

SEQ ID NO: 19026 - RNA, 1623 nt, Artificial Sequence; identical to SEQ ID NO: 17662
  derived and/or modified sequence opt3 from VP1__Norovirus__BAU24950

SEQ ID NO: 19027 - RNA, 1623 nt, Artificial Sequence; identical to SEQ ID NO: 18587
  derived and/or modified sequence opt3 from VP1__Norovirus__BAU24952

SEQ ID NO: 19028 - RNA, 1623 nt, Artificial Sequence
  derived and/or modified sequence opt3 from VP1__Norovirus__BAU24954
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacugggugcccccgacuucgucgggaagauucagggaaugcuuacucagacaacccgcgcugacggcuccacucgaggccacaaggccacaguguacaccgggucagcagauuuugccccuaagcugggaagaguccaauucgagacggacaccgaucaugacuuugaagcuaaucagaacacaaaauucacuccaguggguguuauccaggauggcagcaccacacacaggaaugagccccaacaguggguguugccgaguuacucugggcggaacacucacaauguacaucucgcgccugcagucgccccaaccuuucccggagaacagcuguuauucuuucguuccacaaugccuggcuguagcgguuaucccaacauggaccuggauugccuccuuccacaggagugggugcaauacuucuaucaggaggcugccccugcacagucggacguugcccuguugcgcuuugugaaucccgauaccgggagaguccuauucgaauguaagcugcacaaaucuggcuacgugacuguagcucauacgggacagcacgaccucgugauuccaccgaacggcuauuuuagguucgauuccuggguuaaccaauucuacacacuggccccuauggggaauggagcaggucggcgacgcgucguguga

SEQ ID NO: 19029 - RNA, 1623 nt, Artificial Sequence; identical to SEQ ID NO: 18265
  derived and/or modified sequence opt3 from VP1__Norovirus__BAU24958

SEQ ID NO: 19030 - RNA, 1623 nt, Artificial Sequence
  derived and/or modified sequence opt3 from VP1__Norovirus__BAU24960
augaagauggccagcaacgacgcuaaucccuccgauggcccugcagccaaccuggugccagaggucaauaacgaaguuauggcgcucgagccggugguaggggcugccaucgcagcccccguggcuggacagcaaaaugucauugacccuuggauaagaaacaauuucgugcaggcaccagguggcgaauuuaccguuucucccaggaacgccccuggggagauccuuuggucagcuccacugggacccgauuugaauccuuacuuaagucaccuggcccggauguauaacggcuacgcggguggguucgaagugcaggucauucuagcaggaaaugccuuuacagcuggcaaaaucauuuucgccgcagugccaccgaacuuucccacugagggccucagcccuucccagguaacgauguucccacauaucauaguugacgugcgccaacuggagcccguccuuaucccucugccagaugugcgaaauaacuuuuaucacuacaaucagucuaacgacucgaccauuaaguugaucgcuaugcucuauacaccccugcgugccaacaaugcgggggaagauguguucacugucucaugcagaguucugaccaggccgagcccugacuuugauuucauuuuucucgugcccccaacaguagagagucggaccaaaccuuucacugugcccaucuuaacagucgaagagaugaccaacucccgcuuuccaauaccccuggagaaacuuuucacgggaccuucuagcgccuucgugguucagccacagaaugguagauguacuaccgacggcguguugcuggggacaacucaacuauccccggucaacauuugcaccuuuaggggagaugugacacauaucgcaggcucacggaauuacaccaugaaccucgcuagucugaauuggaacaauuaugaccccacggaagagauuccugccccacuugguacucccgauuucguagggaagauccagggaaugcugacacagaccacuaagggcgacggcagcacacgcgggcacaaggcuaccguuuacacgggaucugccccuuuuaccccaaaauuggguuccgugcaguucgaaacagacacugagaacgauuuugaaacccaucaaaauacaaaguucacucccgucggcgugauccaggacgggggaaccacacaccgaaacgagccgcagcaauggguccucccuucauacagcggcagaaaugugccaaacguucaccuggcacccgccguggcuccuaccuuucccggugagcaguuacuguucuuuaggaguauuaugccaggguguucuggcuauccuaauauggaucucgacugccuucugccccaggaauggguacagcauuucuaccaagaggcggcaccagcccaguccgaugucgcuuugcuacgguuugugaacccggacacuggacguguucuguucgaauguaaacuccacaagagcggcuaugugacggucgcccauacagggcagcacgaucuggugauaccucccaacggauacuuucgcuucgacucguggguaaaucaguucuauacccuugcaccaauggguaacggcacugggagaaggcgggcccuguga

SEQ ID NO: 19031 - RNA, 1623 nt, Artificial Sequence; identical to SEQ ID NO: 18313
  derived and/or modified sequence opt3 from VP1__Norovirus__BAU24962

SEQ ID NO: 19032 - RNA, 1623 nt, Artificial Sequence; identical to SEQ ID NO: 18992
  derived and/or modified sequence opt3 from VP1__Norovirus__BAU24964

SEQ ID NO: 19033 - RNA, 1623 nt, Artificial Sequence; identical to SEQ ID NO: 18992
  derived and/or modified sequence opt3 from VP1__Norovirus__BAU24966

SEQ ID NO: 19034 - RNA, 1623 nt, Artificial Sequence
  derived and/or modified sequence opt3 from VP1__Norovirus__BAU24968
augaagauggccagcuccgacgcuaaccccucugauggcucaaccgcaaaucuggugccugaggucaacaaugaaguuauggcccucgagccagugaucggggcggcuauugccgcaccgguagccggacagcaaaacgugauagaccccuggaucagaaauaacuucguccaggcuccugguggcgaauuuacagugaguccaaggaaugcacccggggagauucuuuggagcgccccucugggaccagauuugaaccccuacuuaucccaccugucucggauguauaauggcuacgcugguggguucgaaguucaggugauccuagccggaaacgcguuuacugcaggcaaaauuaucuucgccgcugucccuccaaauuuuccgacggagggccucucgcccucacaggugaccauguucccucauaugauaguagacguucgccaacuggagccagugcuuaucccccugccugauguccgaaacaauuuuuaucacuacaaccagagcaaugacaguacaauuaaguugaucgccaugcucuauacuccacugcgugcaaacaacgcuggggaugacguguucaccguguccugcagaguccugacaaggcccucuccggauuuugacuucauuuuucucguuccucccaccguggaaagccggacuaaaccauucuccguaccuguguuaacagucgaggaaaugaccaauucacgcuuucccaucccacuggagaaacuuuucacgggacccaguagcgccuucgugguucagccucagaacgguagauguacuaccgauggcguguugcuggggacaacucaacuaucuccagucaauauaugcaccuuuaggggagacgugacacauauuccgggcucccggaacuacaccaugaaucucgcgucacagaacuggaauagcuaugaucccacggaggaaaucccugccccacuggguacucccgacuucguagggaagauucagggaguucuuacacagaccacucgcacaaacggcaguacccgaggccacaaggcaacgguguacaccgggucugcugacuuuuccccuaagcugggaagaguccaauucgccacagauacugacaaugauuuugagaccaaccagaauacaaaauucacuccagugggugucauccaggacggcagcaccacacccaggaacgaaccgcaacaguggguguugccuucguacucugggcggaauauccauaacguucaccucgcuccagccguggcacccaccuuuccuggagagcagcuguuauucuuucguuccacuaugcccggcuguucagguuauccaaauauggaucuggacugccuccuuccucaggaauggguacaauacuucuaucaggaggccgcucccgcgcagagugaugucgcacuguugcgcuuugugaacccagacacggggagaguucuauucgaguguaagcugcacaaaagcggcuacgugacagucgcccauaccggacagcacgaucucgugauuccgccuaacggcuauuuuagguucgacuccuggguaaaucaauucuacacucuggcucccauggggaacggaaccggucggcgacgcgcccuuuga

SEQ ID NO: 19035 - RNA, 1623 nt, Artificial Sequence
  derived and/or modified sequence opt3 from VP1__Norovirus__BAU24972
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacaucacccauauaacaggcagccggaacuacaccaugaaucucgcaucucagaacugguccaauuaugaucccacggaggaaauuccugcuccacuggguacucccgacuucguggggaagauccagggaguccuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauucaggauggcaguacuacccacaggaacgagccccaacaguggguguugccgucuuacuccgggcggaauacaccuaacguacaccucgccccagcugucgcgcccaccuuuccuggagaacagcuguuauucuuucguagcacuaugcccggcuguucggguuauccaaauauggaccuggauugccuccuuccucaggagugggugcaacauuucuaccaggaggcagcccccgcucagucugacguugcccuguugcgcuuugugaacccagauacggggagaguccuauucgaauguaagcugcacaaauccggcuaugugacaguagcacauaccggacagcacgaccucgugaucccgccuaauggcuacuuuagguucgauucauggguuaaccaauucuauacucuggcccccauggggaacggaaccggucggcgacgcgcucuuuga

SEQ ID NO: 19036 - RNA, 1623 nt, Artificial Sequence
  derived and/or modified sequence opt3 from VP1__Norovirus__BAU24974
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaagcaaaccagaauaccaaauucacaccaguuggugugauccaggauggcaguacuacccaucggaacgagccccaacaguggguauugccgucuuacuccgggcguacaaccccuaauguccaccucgccccagcuguggcgcccacuuuuccuggagaacagcuguuauucuuucgcagcacgaugcccggcuguucggguuauccaaacauggaccuggauugccuccuuccucaggaguggguucaauacuucuaucaggaggcagcccccgcucagucugacguggcccuguugagauuugucaauccagauacagggagggugcuauucgaauguaagcugcacaaauccggcuacguaaccguggcacauacuggacagcacgaccucguuauuccgccuaacggcuauuuucgguucgauucaugggucaaucaauucuacacccuggcccccauggggaacggaacaggucgacgcagagcucuuuga

SEQ ID NO: 19037 - RNA, 1623 nt, Artificial Sequence; identical to SEQ ID NO: 18321
  derived and/or modified sequence opt3 from VP1__Norovirus__BAU24976

SEQ ID NO: 19038 - RNA, 1623 nt, Artificial Sequence; identical to SEQ ID NO: 18313
  derived and/or modified sequence opt3 from VP1__Norovirus__BAU24978

SEQ ID NO: 19039 - RNA, 1623 nt, Artificial Sequence; identical to SEQ ID NO: 18313
  derived and/or modified sequence opt3 from VP1__Norovirus__BAU24980

SEQ ID NO: 19040 - RNA, 1623 nt, Artificial Sequence
  derived and/or modified sequence opt3 from VP1__Norovirus__BAU24982
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcuaacuuugccccuaagcugggaagaauccaauucgagacagauacugaccaugauuuugaagcaaaucagaacaccaaauucacaccaguggguguuauucaggacggcaguacuacccacaggaaugagccccaacaguggguguugccgucuuacuccgggcggaacacaccuaauguacaccucgccccagcugucgcgcccaccuuuccuggagaacagcuguuauucuuucguagcacuaugcccggcuguucggguuauccaaacauggaucuggacugccuccuuccucaggagugggugcaauacuucuaucaggaggcagcccccgcucagucugauguugcccuguugcgcuuugugaauccagacacggggagaguccuauucgaauguaagcugcauaaauccggcuacgugacaguagcacacaccggacagcaugaucucgugaucccgccuaacggcuauuuuagguucgacucauggguuaaccaauucuacacucuggcccccauggggaauggaaccggucggcgacgcgcucuuuga

SEQ ID NO: 19041 - RNA, 1623 nt, Artificial Sequence; identical to SEQ ID NO: 18313
  derived and/or modified sequence opt3 from VP1__Norovirus__BAU24984

SEQ ID NO: 19042 - RNA, 1623 nt, Artificial Sequence; identical to SEQ ID NO: 18265
  derived and/or modified sequence opt3 from VP1__Norovirus__BAU24986

SEQ ID NO: 19043 - RNA, 1623 nt, Artificial Sequence
  derived and/or modified sequence opt3 from VP1__Norovirus__BAU24988
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucgaaacagacacugagaacgauuuugaaacccaucaaaauacaaaguucacuccagucggcgugauccaggacgggggaaccacacaccgaaacgagccccagcaauggguccucccgagcuacaguggcagaaaugugccuaacguucaccuggcaccagccguggcucccaccuuuccuggugagcaguuacuguucuuuaggucuacuguacccggguguuccggcuauccaaauauggaucucgacugccuucugccucaggaauggguccagcauuucuaccaagaggcggcacccgcccagagcgauguggcuuugcuacgguuuguuaacccagacacgggacgugugcuguucgaauguaaacuccacaagucgggcuaugucacaguggcccauaccgggcagcacgaucugguaauuccgccuaacggauacuuucgcuucgacucuugggugaaucaguucuauacucuugcacccauggguaacggcaccgggagaaggcgggcccuguga

SEQ ID NO: 19044 - RNA, 1623 nt, Artificial Sequence
  derived and/or modified sequence opt3 from VP1__Norovirus__BAU24990
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacuggaauaacuaugaucccacggaggaaauaccugcuccacuggguacucccgacuucgucgggaagauucagggagugcuuacacagaccacucggacagacggcuccacccgcggccauaaggccacggucuacaccgggucagcugauuuugccccuaagcugggacgagugcaauucgagacagacacugaucacgacuuugaagcaaaucagaacaccaaauucacaccaguuggugugauccaggauggcgggacuacccacagaaaugagccccaacaguggguauugccgagcuacaguggaaggaacacacauaauguccaccucgccccugcuguggcgccaaccuuucccggcgaacagcuguuauucuuucggucuacuaugccugguuguuccggguaucccaacauggaccuggauugccuccuuccacaggaguggguucaauacuucuaucaggaggcagccccugcucagagcgacguggcccuguugcguuuugucaaucccgauacgggccgcgugcuauucgaauguaagcugcauaaaucgggauacguaacaguggcacacaccggccagcacgaccucguuauuccaccgaacggguauuuuagauucgauucuugggucaaccaauucuacacucuggccccuaugggaaaugguaccggcaggcggcgagcuguguga

SEQ ID NO: 19045 - RNA, 1623 nt, Artificial Sequence
  derived and/or modified sequence opt3 from VP1__Norovirus__BAU24992
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggagugcuuacacagaccacucgcacagacggcucaacccgaggccacaaggccacggucuacaccgggagcgcugauuuugccccuaagcugggaagagugcaauucgagacagacacugauagggacuuugaagcaaaccagaauaccaaauucacaccaguuggugugauccaggauggcaguacuacccaucggaacgagccccaacaguggguauugccgucuuacuccgggcguuauacaccuaauguccaccucgccccagcuguggcgcccaccuuuccuggagaacagcuguuauucuuucgcagcacuaugcccggcuguucggguuacccaaacauggaccuggauugccuccuuccucaggaguggguucaauauuucuaccaggaggcagcccccgcucagucugacguggcccuguugagauuugucaauccagauacggggagggugcuauucgaauguaagcugcacaaauccggcuauguaacaguggcacauaccggacagcacgaccucguuauuccgccuaacggcuacuuucgguucgauucaugggucaaucaauucuauacucuggcccccauggggaacggaaccggucgacgcagagcucuuuga

SEQ ID NO: 19046 - RNA, 1623 nt, Artificial Sequence; identical to SEQ ID NO: 18319
  derived and/or modified sequence opt3 from VP1__Norovirus__BAU24994

SEQ ID NO: 19047 - RNA, 1623 nt, Artificial Sequence
  derived and/or modified sequence opt3 from VP1__Norovirus__BAU24996
augaagauggccagcuccgacgcuaaccccucugauggcucagcagccaaucuggugccugaggucaguaacgaaguuauggcgcucgagccagugguaggggcugccaucgcagccccgguggcuggacagcaaaaugucauugaccccuggauaagaaacaauuucgugcaggcaccugguggcgaauuuaccguuagcccaaggaacgcccccggggagauccuuugguccgcuccucugggaccagauuugaaucccuacuuaucucaccuggcccggauguauaacggcuacgcggguggguucgaagugcaggucauucuagcaggaaaugccuuuacagcuggcaaagugaucuucgccgcaguaccuccaaacuuuccgacugagggccucucgcccucacagguuacgauguucccucauauuguggucgacgugcgccaacuggagccagugcuuaucccccugccugauguccgaaauaacuuuuaucacuacaaucagagcaacgacccaaccauaaaguugaucgcuaugcucuauacaccccugcgugccaauaacgcgggggaugacguuuucacugugaguugcagaguacugaccaggccguccccugauuuugacuucauuuuucucgugcccccaacagucgaaucucggaccaaaccuuucagcgugcccguuuuaacuguggaggaaaugacaaacucccgcuuuccaaucccccuggagaaacuuuucaccggaccuucaagugccuucgucgugcagccacagaaugguagauguacgacugauggcguauugcuggggaccacacaacuaagcccgguuaacauuugcacuuuuaggggagacgugacccauaucacaggcucucggaauuacaccaugaaccucgcaucccagaauuggucaaacuaugaucccacggaggaaauaccugcuccacuggguacucccgacuucgucgggaagauucagggagugcuuacacagaccacucgcacagacggcagcacccgaggccacaaggccacggucuacaccgggagugcugauuuugccccuaagcugggaagagugcaauucgagacagacacugauagggacuuugaagcaaaucagaacaccaaauucacaccaguuggugugauccaggauggcucuacuacccaucggaaugagccccaacaguggguauugccguccuacagcgggcguaacacaccuaauguccaccucgccccagcuguggcgcccaccuuuccuggagaacagcuguuauucuuucgcucgacuaugcccggcuguucugguuauccaaacauggaccuggauugccuccuuccucaggaguggguucaauacuucuaucaggaggcagcccccgcucaguccgacguggcccuguugagauuugucaauccagauacggggagggugcuauucgaauguaagcugcacaaaucaggcuacguaacaguggcacauaccggacagcacgaccucguuauuccgccuaacggcuauuuucgguucgauaguugggucaaucaauucuacacucuggcccccauggggaacggaaccggucgacgcagagcucuuuga

SEQ ID NO: 19048 - RNA, 1623 nt, Artificial Sequence; identical to SEQ ID NO: 18313
  derived and/or modified sequence opt3 from VP1__Norovirus__BAU24998

SEQ ID NO: 19049 - RNA, 1623 nt, Artificial Sequence
  derived and/or modified sequence opt3 from VP1__Norovirus__BAU25002
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacagcaccauaaaguugaucgcuaugcucuauacaccacugcgugccaacaacgcgggggaugacguuuucacugugaguugcagaguacugaccaggcccuccccggauuuugacuucauuuuucucgugccucccacagucgaaucucggaccaaaccauucagcgugccuguuuuaacuguggaggaaaugacaaauucccgcuuucccaucccacuggagaaacuuuucaccggacccucaagugccuucgucgugcagccucagaacgguagauguacgacugauggcguauugcuggggaccacacaacuaagcccaguuaauauuugcacuuuuaggggagacgugacccauaucacaggcucucggaacuacaccaugaaucucgcaucccagaacuggucaaauuaugauccgacggaggaaauacccgcuccucuggguacuccagacuucgucgggaagauucagggagugcuuacacagaccacucgcacagacggcagcacccgaggccacaaggccacggucuacaccgggagugcugauuuugcccccaagcugggaagagugcaauucgagacagacacugaucaugacuuugaagcaaaccagaauaccaaauucacaccuguuggugugauccaggauggcucuacuacccacaggaacgagccacaacaguggguauugcccuccuacagcgggcggaauacaccgaacguccaccucgccccugcuguggcgccaaccuuucccggagaacagcuguuauucuuucguucgacuaugccuggcuguucugguuaucccaauauggaccuggauugccuccuuccacaggaguggguucaauacuucuaucaggaggcagccccugcucaguccgacguggcccuguugcgcuuugucaaccccgauacggggagagugcuauucgaauguaagcugcauaaaucaggcuacguaacaguggcacacaccggacagcaugaccucguuauuccaccgaauggcuauuuuagguucgauaguugggucaaccaauucuacacucuggccccuauggggaacggaaccggucggcgacgcgcucuuuga

SEQ ID NO: 19050 - RNA, 1623 nt, Artificial Sequence; identical to SEQ ID NO: 18265
  derived and/or modified sequence opt3 from VP1__Norovirus__BAU25004

SEQ ID NO: 19051 - RNA, 1644 nt, Artificial Sequence
  derived and/or modified sequence opt3 from VP1_protein__Norovirus__ADN84676
augaagauggccagcuccgacgcugcacccucuaccgauggcucagccgggcuggugccugaggucaacaaugaaacaauggcgcucgagccaguugugggagcuccgcuugccgcacccguagccggucagcacaacaucauugacccuuggauaaaaaugaauuucgugcaagcuccaaacggcgaauuuacugucagucccagaaaugcaccuggggagauccuguuggauuuagaacugggaccagaccuaaaccccuaccucagccaucuggccaggauguauaauggcuacgcuggugggauggaggugcagguugugcuugccggaaacgcguucacggcaggcaagauuaucuuugccgcugucccuccaaauuucccggccgagaaccuguccgcagcucaggugaccaugugcccccacguaauuguugaugugcggcaguuggaaccugucaugcucccaaugcccgacauccgcaauaaacuguuucauuauaaccaaguggaugacccuaagcugcgacucuuagccuaccuguauacaccacuucgugcgaauaacgccggcgaugacguguucacugucucuuguagaguuuugaccaggcccacaccggauuuugaguucauguuucuggugccucccaccguagaaucgaaaacuaagccauucucacuaccuaaucucacacuggacgagcuuagcaacagucgguuucccgcaccaauagugcagcuguacaccaacccccacgauaauuuggucgugcagccucagaacgggcgcugcacgaucgacggacuccugcaagguacuacccaguuaguuuccuguaaugugugcucuuucagaggcacaaugggggagggacagccagcuagccauuccgaagacgagauuaugccgauggccaucaacguccagagggaaauuaugcuggagaaucucgauggcucacccuaugacccuacugaugacaucccagcugugcuugguagucccgauuuucaagggguaauguucggaauacugagccagcggaacaccgacggccagacacgcgcccacgaagcaaagguugauacccgagccgcuagauucgcgccuaaauugggcuuuguggucgcaacgguggagucuacugacuuccacgccaaucaaccauccagguuuacacccgucgggcuaggaggugaugcuaaccgggacuucaaucaguggcagcugccggccuacggcggggcacucaccaacaauacuaaccuggccccuccagugaugcccguuuacccuggagagcagcuucuguuuuuccguucacaauugcccagcaguggcggugugguagcuggguggcucgauugucuguuaccacaggaauggguccagcacuuuuuccaggagucugccacaucccaaagcaauguggcacugguucgcuaugugaacccuaccacgggcagaguccuauuugaagcgaagcuccauaaacagggauuccugaccguggcugccucgggcucuuacccccuuguagugccagcagacggguauuuuagguucgaguccuggguuaaugaauuuuacacauuggccccgaugggaaacgguucaggccggcgacgcgcuagauga

SEQ ID NO: 19052 - RNA, 1623 nt, Artificial Sequence
  derived and/or modified sequence opt3 from VP1_protein__Norovirus__BAK68870
augaagauggccagcaacgacgcuucccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggucuaccacacaccgaaaugaaccccagcaaugggugcucccguccuacagcggaagaaacguucacaaugugcaucuggccccugcaguagcuccaaccuuucccggcgagcaguuacuguucuuuaggucgacuaugccugguuguucuggguaucccaacauggaucucgacugccuucugccacaggaguggguccagcacuucuaccaagaagcggccccugcacaguccgauguggcuuugcuacgguuuguuaaucccgacacgggccgugugcuguucgaguguaaacuccauaagucaggauaugucacaguggcccacaccggccagcacgaucugguaauuccaccgaacggguacuuucgcuucgacaguugggugaaccaguucuauacucuugcaccuaugggaaaugguaccggcagaaggcgggcccuguga

SEQ ID NO: 19053 - RNA, 1620 nt, Artificial Sequence
  derived and/or modified sequence opt3 from capsid__Norovirus__AAC54893
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaagucauuuucgcugccgugccuccaaauuuuccgacugagggccucucgcccucacagguaacgauguucccucauaucauaguugacgugcgccaacuggagccaguccuuaucccccugccugaugugcgaaacaauuuuuaucacuacaaccagagccaugacaguaccuugaagcucauugcaaugcuguauacaccacugcgugcuaauaacgccggggaugacguguucacugucuccugcagaguucucaccaggcccucuccggauuuugacuucaucuuuuuagugccucccacaguagaaagccggaccaaaccauucacugugccuauucugacagucgaggaaauguccaacucacgcuuucccaucccacuugagaaguuguacaccggacccaguagcgcguucgugguucagccucagaaugguagauguacgacugauggcgugcugcuagggaccacacaacucucugccgucaacauaugcaauuucaggggagacgugacucacauuguaggcucccaugauuauaccaugaaccuggcaucacagaauuggagcaacuacgacccaacagaggaaaucccggcuccccuugguaccccugacuuuguugggaaaauucagggacuguugacgcagacuacacgggccgauggcaguacccgcgcucacaaggccacugugucuacaggcuccguccacuucaccccaaagcucgggagcgugcaauuuacgaccgacacaaauaacgauuuccagacuggacagaauaccaaauuuacacccgucggugugauccaagacggcgaucaucaccagaacgagccucagcaguggguucugccaaauuacucggggcgaacuggacauaacgugcacuuagcacccgccguagcuccgaccuucccuggcgaacaacugcucuuuuucagaucuacaaugccagguuguuccggguaucccaauaugaaccuugacugccuguugccucaggaguggguccuacacuuuuaccaggaagcggcacccgcccagucagauguggcucugcucagguucguuaauccagacaccggccgggugcuguuugaguguaaacuucauaagaguggauauaucacugucgcccacacgggcccuuucgaucuggugauucccccaaacggguacuuucguuucgacagcuggguaaaccaauucuauacauuggcaccgaugggaaaugguaccggccgcagaagggcccucuga

SEQ ID NO: 19054 - RNA, 1647 nt, Artificial Sequence
  derived and/or modified sequence opt3 from capsid__Norovirus__AAW30195
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggagcugacugugucuccaagaaauucacccggagaaguauuguuaaaccuggagcuaggcccugaaaucaauccauaccucgcucaccuggccaggauguauaacgguuacgcagggggauuugaggugcaggucgugcuugcaggcaaugccuucacggcuggcaaaauuaucuuugccgcaauacccccuaacuucccaaucgacaaucugagugcugcccagauuaccaugugcccgcauguuaucguggauguccggcaauuggagcccgugaaccucccuaugccagacguacgcaauaacuuuuuccacuauaaccaggggagcgauacacgacugcgucugauugcgaugcucuacacucccuuaagagccaauuccucuggagacgauguuuuuaccgugucguguaggguccugacacggccuucaccagacuucagcuuuaacuuccuugugcccccgaccguggaaaguaagacuaaaccuuuuacauugcccauccugaccauauccgagaugucuaauagccgcuucccagucccuauugauucccuacauacgucacccacugaaaacaucguugugcagugccagaaugguagaguaacccucgacggcgagcugauggggacaacucaacuucugccaagucagauuugugcauuuaggggaauguugacccggagcacaucucgcgcuuccgaucaggccgacaccgcugcaccccgacucuucaacuaucacuggcauauccagcuggacaauuuaaacggcacgccuuacgauccagccgaggacaucccggguccccuggggacuccugauuucagaggaaagguguuuggcgucgccucacaaaggaauccagacagcacaacccgggcucacgaagcgaaaguggauacuacagcaggccguuucacccccaagcucgggagucuugagauuucuacggaauccggagaccuggaucagaaccagccuaccaaguuuacaccaguugguauaggcguggaccacgaggaagauuuccaacaguggagcuugcccgacuauucggggcaguuuacucauaauaugaaccuagccccggcugucgccccuaauuucccaggagagcagcugcucuuuuuccgcucucaacugcccuccucaggcgguagaaguaacgggauccuugauugccuggugccucaggaguggguacagcacuuuuaccaggaaagcgcacccgcccaaacccagguugcuuuggugagguacgucaauccagacacaggccggguccucuucgaggccaaacugcauaaguuaggauuuaugacuauugcgaaaaacggcgacuccccuaucaccgugcccccaaacggguauuucggauuugaaucuugggugaauccguucuacacacuggcgccuauggguaccggcaacgggcgacgcagaauacaguga

SEQ ID NO: 19055 - RNA, 1647 nt, Artificial Sequence
  derived and/or modified sequence opt3 from capsid__Norovirus__ABD36491
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaguuauuuucgcagcuauacccccuaacuuuccaaucgauaaucuuagugccgcgcagaucacgaugugcccgcaugugauugucgacgugcggcaacuggaacccaucaacuugccuaugccagauguacgcaauaacuucuuucacuauaaccaggggagcgacucccgacuccgucugauugccaugcuguacacaccccucagagcaaauaacucuggagaugacguuuucaccgugucguguagggucuuaacucggccuucaccagauuuuagcuucaauuuucuggugcccccgaccguggagaguaagacaaaaccuuucacccuucccaucuugacuauauccgaaaugucuaacagccgcuuuccagucccuauugacucccugcauacaucacccaccgagaauaucguugugcagugccagaacgguagaguaacgcuagauggcgagcucauggggacuacccaacugcuuccaagucagauuugugcuuucaggggaacacugacucggagcaccucucgcgccuccgaccaggcugauacagccacgccccgauuguucaauuauuacuggcacauccagcucgacaaccugaauggcaccccuuaugacccagcagaagauaucccggcccccuuagguacuccugacuuuagagggaagguguucggagucgcuucacaaaggaacccagauagcacaacccgggcgcaugaggcaaaaguggacacuacaaguggccguuuugcccccaagcugggcucucucgaaauuuccaccgagagcucggauuucgacucuaaucagccuacgcgcuuuaccccaguugggauaggaguggauaacgaagcugacuuccagcaauggucccuucccgauuacucaggucaguuuacacacaauaugaaccuggccccggcagucgccccuaauuucccaggcgagcaguugcuauuuuucagaagucagcugcccagcuccgggggaaggucuaacggcauccucgacugccuggugccucaagaguggguacagcacuuuuaccaggaaagcgcucccgcccagacucaaguugcacuugugcgguaugucaacccagauaccggucgagugcuguucgaggcgaaguugcauaaacucggguuuaugacaauugcuaagaauggcgacucaccuaucacugugcccccaaacggauacuuccgcuucgaaaguugggucaauccguuuuauacccuggccccuaugggcacagggaacggaagaaggcggauacaguga

SEQ ID NO: 19056 - RNA, 1629 nt, Artificial Sequence
  derived and/or modified sequence opt3 from capsid__Norovirus__ABD36494
augaagauggccagcaacgacgcugcacccuccaaugauggcgccgcgucucuggugccugaggggaucaacgaaaccaugccacucgagccggucgcuggagccucaauugcagcccccguugcuggucagacaaauauaaucgacccuuggauuagaacuaacuucgugcaagcaccaaauggcgaauuuacgguaagucccaggaacagcccuggggagauccuucugaauuuggaauuaggaccagaucugaaccccuaccuagcccaccucucccggauguauaauggcuacgcuggugggguggagguccaggugcugcuugccggaaacgcguucaccgcaggcaaaauucuguuugccgcuaucccuccaaauuucccgguugacaugauaucucccgcccagaucacaauguugccucaucucauuguggauguccgcacucuggagccaaucaugauuccccugccugacgugcgaaacguauuuuaucacuucaauaaccagccacaaccccguaugagacucguugcaauguuauacaccccgcugaggucgaauggcucaggggaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgcuccaaacgagaauaacguugugcagugucagaauggaaggugcacacuugacggugaacugcaaggcacuacccaguugcucuccucagccaucuguaguuaucgggggcgcacaguagcgaacaauggagauaacugggaccagaaucuguuacagcugaccuacccgaacggcgccagcuacgaucccacggacgaggugccugcaccacucgguacucaagacuucucugggaugcuuuauggaguccugacacaggauaauaccaacguguccgcuggcgaagccaagaaugcuaaaggcaucuacauuucaacuacaagcgggaaguuuacccccaagauaggaaguaucgguuugcauucuauuacggagcacguuuauccuaaccagcaaucccgauucaccccagugggcgucgccgugaaugaaaacacacccuuccagcaguggguacuaccgcauuacgcagggagccuggcccucaauacuaaccuggcuccugcgguugcaccaaccuuucccggagagcagcuucuguucuuuagaucgagggugccuugcguccaaggccagcagggucaggacguguucaucgauuguuugcucccccaagagugggucaaccacuuuuaucaggaagccgcuccaucucaggccgacguggcacugauacgguacguuaauccugauacagggcguacuuuauucgaggccaaacugcaccgcuccggcuuuauuaccgugucacauacaggagcuuauccccuaguagucccaccgaacggccacuucagauuugacaguugggugaaucaguucuacagccucgccccuauggggaccggaaacgguaggcggcgaauccaauga

SEQ ID NO: 19057 - RNA, 1614 nt, Artificial Sequence
  derived and/or modified sequence opt3 from capsid__Norovirus__ABD36497
augaagauggccagcaacgacgcugcacccuccucugauggcgccgcggggcuggugccugagaucaaucacgaagucauggcuauugagccaguugccggagcaucaauagccgcuccggugguaggucagcaaaacaucauugaccccuggaucagaaauaacuucgugcaggccccugcaggcgaauuuaccgucaguccaaggaaugcucccggggaguuccuccuugaucuggaauugggaccugacuuaaacccauaccuggcccaucuagcgcggauguauaauggccacgccggugggauggaggugcagauuguucucgcaggaaacgcuuuuacagccggcaaaauccuguucgcagugauacccccuggcuuuccauacgagaaucuuagcccggcucagcugacuaugugcccccaugucgugguagauguucgccaauuggaaccugugaugcucccaaugcccgacauccgaaacacguucuuucacuauaaucaggaugggggaccucgucugagacugauugccaugcucuacaccccauuaagggcgaacaauuccggugacgaugucuucacagugucuugucgggugcugacucgccccgccccggacuuugaguucaccuuucuugucccucccucgguugaaucaaagacaaaagcauucaccaucccaguguugaagauuagcgagaugacuaacaguagauuuccuguacccguggaucagauguauacauccaggucugagggcaucgucgugcagccacaaaaugggcgggcuaccauagacggagaacugcuaggcacgacucucguuagccccguguccgucugcaacuucaaagguaaccugcagaccgaggugccugggcagcaucagcaauaccagcuucagcugacaaauuuggauggaucaccaauugacccgacugacgauacccccggcccucucggcuguccagacuucaucgggcuguuauauggaguagccagucaacgcggucccggcgaugcuacacgagcccacgaagcaagaauugacaccgggagcgauacguacgccccuaagaucggacagguuagguuuuacucuacuuccaacaauuucgagacaaaccagccaacccacuuuacucccgugggcgucuauaucgaagguucaagcagugacuucaaucaguggcaacugccgcgguacgggggccaucucgcuaacaauaaccaccuugcgccugcagugucuccacuguuucccggagagcagauuuuguucuuucguuccuucauaccuggcgccagcgggcauacaaauggagagauggauugccuacugccccaggaauuuguccagcacuucuaucaagaggcugccaccgcacagucggaaguggcccuccugcgcuuuguuaacccagacacggguagagugcuuuucgagucuaagcugcacaaacagggcuuuaugaccaucgcuuccucaggggaucauccuauuaucaugcccacaaauggauacuucagguucgaagccuggguaaaccaguuuuauaguuuggcaccagucggcacugguagcgggcggcgacgcauacaauga

SEQ ID NO: 19058 - RNA, 1623 nt, Artificial Sequence
  derived and/or modified sequence opt3 from capsid__Norovirus__ABL74387
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugaggcuggucagaacacuagauucaccccagucggcgugguucaagaugggucuacaacccaccagaaugaaccccagcaguggguguugccggacuacuccggaagggauagccacaacguacaucucgccccugcagucgccccaacuuuucccggcgagcaacuguuauucuuucggucgacgaugccugguuguucuggguaccccaauaugaaccuggacugccuccuuccacaggaaugggugcagcacuucuaucaggaguccgcuccugcgcaaucagauguugcacuguugcguuuugugaaucccgacacaggccgcguccuauucgaguguaaacugcauaagaguggauacgugaccguagccuauacuggccagcacgaucucgugaucccaccgaacggguacuuuagauucgacagcuggguuaaccaguucuauacccuggcuccuaugggaaauggugccggcaggcggcgagcacuuuga

SEQ ID NO: 19059 - RNA, 1623 nt, Artificial Sequence
  derived and/or modified sequence opt3 from capsid__Norovirus__ABL74389
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauucguuugaucgcaaugcucuauacgccccugagagcuaacaacgccggggaugacguguucacagucucaugcaggguucugacccggccgagcccugauuuugacuucauuuuucucgugcccccaacuguagaaagucgcacaaagccuuucuccgugcccaucuuaaccgucgaggaaaugaccaauucuagauuuccaauaccccuggagaaacuuuucacuggaccuagcuccgcguucgugguucagccacagaacgguagguguaccacagauggcguguugcuggggacuacccaacuaucaccggucaauauuugcacauuucggggagacgugacccauaucgccggcacgcagaacuacacuaugaaucucgcaagucagaacuggaauaacuaugaucccacagaggaaguaccugcuccacuggguacccccgacuucguugggaagauucagggagugcuuacucaaacaacccgcggcgacggcagcacgcgagggcacaaagccaccgucucuacaggauccgugcauuuuacuccuaagcuggguucaguccaguucagcaccgauacaaguaaugacuuugagacuggccagaacaccagauucacaccaguggggguugugcaagauggaucuaccacucaccagaaugaaccccagcaguggguauugccggacuacuccggcagggauaaccacaauguccaucucgcuccugccguggcaccaacguuucccggugagcaacuguuauucuuucggagcacaaugccuggguguucgggcuaccccaacaugaaucuggacugccuccuuccacaggaauggguucagcacuucuaucaggagucugccccugcucaauccgauguggcgcuguugcguuuugucaaccccgacaccggacgcgugcuauucgaguguaagcugcauaaaucaggcuacguaacuguggcacacaccgggcagcacgaucucguuaucccaccgaacggauauuuuagauucgacaguugggucaaucaguucuacacacuggccccuauggguaacggcgcugggaggcggcgagcccuuuga

SEQ ID NO: 19060 - RNA, 1623 nt, Artificial Sequence; identical to SEQ ID NO: 18112
  derived and/or modified sequence opt3 from capsid__Norovirus__ABL74397

SEQ ID NO: 19061 - RNA, 1593 nt, Artificial Sequence
  derived and/or modified sequence opt3 from capsid__Norovirus__ABQ44562
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcggcauggguauuucuccugauaaugugcaauccguccaguuucagaacgggagauguacucuugacggaaggcuggugggcaccacacccguuucauugagccauguggccaaaauccggggcaccaguaaugggacggucauaaaccucacugaacuggacggaacaccauuccaccccuucgaggguccugcuccaauuggcuuuccggauuuagggggaugcgacuggcacaucaauaugacccaguucggccauucuucccaaacucaguacgauguggacacaacccccgauacguuuguaccucaccuggguagcauucaggccaacgggguuucgucuggcaauuauaucggagugcucuccugggucucaccacccagucauccuagcggcucccaaguggaccuuuggaagaucccaaacuacgggucuagcauuaccgaggcgacacaccuggcccccucagucuauccgccuggauucggugaaguguugguguuuuucaugaguaaaauaccaggccccggggcauacucccuaccuugucugcucccccaggaguauaucagccaccuggcuucugaacaggccccaacuguuggagaggcugcccuucugcauuacguagauccugacaccggccgcaauuugggugaguuuaaggcauaccccgauggguuccucacaugcgucccaaacggcgccucaaguggaccgcagcaacugccuauuaauggcguguuuguuuucgugagcugggucucccgauuuuaucaguuaaagcccguggggacugcuucuaccgcgagaggaaggcugggucuacggcguuga

SEQ ID NO: 19062 - RNA, 1638 nt, Artificial Sequence
  derived and/or modified sequence opt3 from capsid__Norovirus__ABQ44563
augaugauggccagcaagggcgcucccaccaacauggacgggacauccggagcaggucagcuggugccugaggccaauacugcggaaccaaucucuauggagccggucgcuggcgccgcaacggccgcugcaaccgccgggcaaguuaacaugauugaucccuggauaaugaauaacuacgugcaggcuccucagggagaguucacaaucucaccaaauaacacucccggcgacauucucuuugaucuucagcuggguccucacuugaauccauucuuaagucaucuggcccaaauguauaacggguggguaggaaauaugaaagugaagguccuacucgcgggcaacgcauuuaccgccggcaaaaucauuaucagcugcauacccccuggguucguggcucagaauaucuccauugcccaggcaacaauguuuccacacguuaucgcugacgugagaguccuggaaccgauugaagugccccuugaggauguaaggaacguucuguuccauaauaacgacaauaccccuacuaugcgguugguguguaugcucuacacaccacugcgcgccucuggaucgucaagcgguaccgaucccuuugucaucgcgggccgagugcugacgugcccuaguccagacuucuccuuucucuucuuagugcccccgaacgucgagcagaagacuaaaccuuuuucuguucccaaccugccacuuaauaccuugagcaacucccgugugccuucacugauaaagaguaugaugguaagcagagaucacgggcaaauggugcaguuccagaauggaagggucacacuagacggccagcuccaagguacuacccccacaucugccucccagcuguguaagauucgggggucaguguuucaugcaaacggaggcaauggcuauaaccuuaccgaacuggaugggagcccauaccacgcuuucgagagucccgccccuaucggauucccagacuugggugaaugcgauuggcacauggaggcuucuccgacgacucaguuuaauacaggcgacguuauuaaacaaaucaacgugaagcaggaguccgccuucgcaccccaucucgggaccauccaggccgacggacugagcgaugucucggugaauacuaacaugauugcuaaauuagaauggguaucuccuguuuccgacggccacaagggugauguggacccaugggucauaccccgcuaugggucaacacugaccgaggcggcacagcucgccccuccaaucuaucccccgggcuuuggagaagcuauuguguucuuuaugagugauuucccuaucgcccauggcacgaaugggcuuagcgucccauguaccauaccccaagaguuugugacacacuucguuaacgaacaggcaccuacuagaggagaggccgcucuguugcacuaccuagaccccgauacccauaggaaucugggugaguuuaaacucuacccagacggcuucaugacaugcgugccuaacuccucugggacuggaccccagacccugccaauuaauggcguauuugucuucgugagcuggguuucacgguuuuaccagcuuaagccgguggguacagccgggccugcacgccgacugggcaucagaaggaguuga

SEQ ID NO: 19063 - RNA, 1635 nt, Artificial Sequence
  derived and/or modified sequence opt3 from capsid__Norovirus__ABQ44564
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaaaaagucuugaaccucacugagcuggacgggagcccauucauggcauucgcugccccggcgcccgccggauuuccugauuuagguucuugcgacuggcacauugagguguccaagaucccaaauucaagcacacagaguaaccccauuguaguuaauucugugaagccuaacucccagcaguucgucccacaucugagcucgaucacccucgaugacaaugugucuuccggcggggauuacaucggaacgauucaauggaccucacccccgagugacagcggcggugcaaacacaaauuuuuggaaaauaccugauuauggguccucucuugcugaagccagccagcuggcuccagccgucuaucccccuggcuucaacgaggugaucguuuacuuuauggcaucaauucccggaccaaaucagaguggcuccccuaacuuggugcccugucuacugccacaggaauacaucacucacuucauaagcgagcaagccccgauucagggggaggcugcgcuccugcacuacguagacccugauaccaaucgcaaccuuggagaauuuaagcuguaucccgguggcuacuugacaugcgucccaaauucuucaaguacugggccccagcagcucccucuggacggaguguucguuuuugcaagcugggugucccgauucuaucaauuaaaaccagucggcaccgccggucccgcuagagggaggcugggcgugcggcguuga

SEQ ID NO: 19064 - RNA, 1623 nt, Artificial Sequence
  derived and/or modified sequence opt3 from capsid__Norovirus__ABQ44565
augaugauggccagcaaggacgcucccaccuccccugauggcgcaucuggggccggacagcuggugccagaagcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguuccauaauucuucgcagccucaaccaacuaugcgucucguagcuauguuauauacaccccugagaaccgggggagguucaggcgggacggaugccuuuguuguggcgggaaggguccuuacuugcccugccccagacuucagcuuuuuguuccuggugcccccgaguguggagcagaagacccgggucuuuuccguuccuaacgugccccuaaaagaucucucuaauagccgcguaccagugccuauucagggcauguucaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcagccccuuuauuccucuggaaaguccagcuccggugggguuccccgacuuaggagguugugauuggcacguaaauuuuacauuccaggcccaagaccaggauccuucucaguccguuaccuuugcuacgaacgacgccagcuucgugccauaccugggcucgaucucuccccauaaugggggagauuuucacuccggcgacauuaucgguucacucggguggaucagugcaccuagcgauuccucucagcuuaacgucuggacuauuccaaaguauggcagcucacugcccgacgugacacacuuggccccggcugucuucccuccaggauuuggcgaggugauacuauacuucuauaguaccuuucccggguccggacaaccuggucagcugcagguucccugccuccugccacaggaguucaucacucauuuuuguaaugaacaagcgccuauugcaggcgaggccgcccuucugcacuacguggaucccgacacagggcgcaacuugggagaguucaagcucuauccagauggcuucaugaccugcguaccgaauagcgucucuucagguccucagacgcugcccaucaacgggguguuuguuuucgugaguugggucagccgauuuuaccaguuaaaaccagugggcaccgcuuccguagcaagaaggcugggacuacggcguauauga

SEQ ID NO: 19065 - RNA, 1635 nt, Artificial Sequence
  derived and/or modified sequence opt3 from capsid__Norovirus__ABQ44566
augaugauggccagcaaggacgcucccaccaacauggauggcacauccggggcaggacagcuggugccugaggccaauacugcggaaccaaucucuauggacccggucgcuggugccgcaacggccguugcuaccgcaggccaaauuaacaugauagaucccuggaucaugucaaauuucgugcaggccccucagggggaguuuacaguaaguccaaacaauacucccggagacgugcuguucgaucuucagcugggcccucaauugaacccauuuuuagcucaccuggcccagauguacaaugguugggucgggaacaugagagugaaaguucuacucgcgggaaaugcauucaccgccggcaagauuaucauuagcugcauacccccuggcuuuacaucccagaacaucucuaucgcucagaugaccauguucccacaugugauugccgacgucagggugcuggaaccgaucgagguaccccuugaagauguucggaaugugcuguuucacacuaacgacaaucgcccuacaaugcgauuggucuguaugcucuauaccccacugcgugcaaacgggucgucaagcggaacggaucccuucgugauugcugguagagugcugacuugcccugacaguaauuuuuccuuccucuuuuuagucccacccaacguugagcagaaaaccaggccguucucugugccuaacaucccccugaauacacuuagcaacucccggguaccaucauugauaaagaguaugacuauuagccgcgaucaaaaucagaucauucaguuucaaaacggcagagugacccuggacgggcagcuacagggaacaaccccuacgucugucucccaacucuguaaaaucaggggcacuacauaccaugccaccggugggaauggaaucaaccugacugagcuuaauggcgaacccuaucacgcguucgagucaccagcccccauuggcuucccugaucucgggggaugcgacuggcauuugacagcaaccccaacgcaggcuuuuaacgacggugccaaggugguucggcucagcgugacccagggcgcugccuucgcaccgcaccuggggacaauacacuacacuaccacagauacugacuauagucccaauaccucuaucauuuguacauuagauuggcugucccagaccacuggacaaagcaacgucgacccuuggcagaucccaacguacggcucgacacucaccgaagccgcucagcuugcgcccccuauauuuccacccgguuucggggagacucugguguuuuucuugucugauuuuccgauuuccaauggcaagaacggacuaucaguaccuugcacccugccacaggaguucguuacacauuuugugaaugaacaagcacccauccgcggcgaggccgcucuccugcacuaugucgacccugauacccaucgaaaccuuggggaguucaaacuguaccccgaaggauuuaugacuugugugccaaauacaagugguggcgggccucagacguugcccaucaacggagucuucguguuuguuagcuggguguccagauucuaccagcucaagccaguaggcaccgccggugcagccaggcggcuggggauucgucgcucuuga

SEQ ID NO: 19066 - RNA, 1608 nt, Artificial Sequence
  derived and/or modified sequence opt3 from capsid__Norovirus__ABQ44567
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagauccuguugaauuuagaacugggaccugagcuaaacccauuccucgcccaccugagccggauguacaauggcuaugcugguggggucgaggugcagguucuucuggccggaaacgcguuuacggcaggcaaauugguguucgccgcuauucccccucauuuuccaaucgaaaaucucuccccgggccagauuaccauguucccccacgucaucauagaugugcgcacacuggagccuguacugcucccauuacccgacguucgaaacaacuuuuuccauuacaaucaggaaccugagccacguaugagacugguggccaugcuuuauacucccuugaggucuaacgggucgggagaugacgucuuuaccgugucaugccgggugcugacacgcccgagcccugauuucgacuuuaauuaccuaguucccccaaccgucgagaguaagacuaaaccuuucacacuccccauccugaccauuggugaacuuuccaacucuagauuuccagcacccaucgaugagcuguauacgagcccuaaugaaggcuuggugguacaaccacagaacgggagguccacucucgacggagagcuguuaggcaccacacagcuggugccgucaaauauuuguagucuccggggucgcaucaacgcucaccuucccgauaaucagcaucgauggaacaugcaagucacuaaugccaacgggaccccuuucgacccaacagaagaugugcccgcgccucugggaaccccagacuucuuggccaauauauacggcguuacgagccagagaaaccccgacaauacuugcagggcacacgauggcauucuagcuacauggucuccgaaguuuaccccuaaacugggguccgugguccucggaacuugggaggaccgggauuucgacaucaaccagccaacacguuuuacccccgugggucuguaugauacggaccacuucaaucagugggcccuuccuaacuacucaggcgcucugaccuugaacaugaaucucgcccccagcguagcaccacuguuuccuggggagcaauuacuguucuuucgcagucauauuccccuaaagggaggcacaucuuccggugccaucgauugucuccugccacaggaauggguucagcacuucuaccaagagagcgcuccgucgucuacugacguggcgcuuaucagauauaccaacccugauacagggagggucuuguuugaagcaaagcugcaucggcagggcuucauuacuguggccaauuccggaucacgacccauagucgugccacccaacggcuacuuucgcuucgacaguuggguuaaucaguuuuauagccucgcuccuauggggaccggaaacgguagaaggcgggugcaguga

SEQ ID NO: 19067 - RNA, 1629 nt, Artificial Sequence
  derived and/or modified sequence opt3 from capsid__Norovirus__ABQ44568
augaacauggccagcaaugacgcugcacccuccaccgauggcgccgcggggcuggugccugagucuaacaaugaagucauggcucucgagccaguugccggagcagcccuugcugcaccggugacaggucagacuaacaucauugaccccuggauaagagccaauuucguacaagcuccuaacggcgaauuuacggugucaccaaggaaugcccccggggagguccuguugaacuuagaacugggaccugagcuaaauccauaccucgcgcaccuggcacggauguauaacggcuacgccggugggauggaggugcagguuaugcuugcuggaaaugccuucaccgcaggcaagcugguguuugcugccgugcccccucauuucccagucgaaaacuugaguccgcagcagaucacaauguuuccccacguaauuaucgauguucgcacucucgagccugugcugcugccacuccccgacguccgaaauaacuucuuucauuauaaucaaaaagaugacccuaagaugcguauuguggcgauguuauacaccccacugagaagcaacggcuccggggaugacguguucacagucucuugcaggguucuuacccggcccucgccggauuuugacuucacuuauuuggugccucccacaguagaaucaaaaaccaagccauuuacgcugccuauccuaacucucggagagcugagcaacagucgcuuccccguguccauagaucagauguacaccucuccaaaugaggucaucagcgugcagugucagaacgguagaugcacacuugacggcgaacugcaagggacuacccaguugcagguuuccggaauuugugccuuuaaaggcgaggugacagcacaccuccaugauaaugaccaccuguauaacgucaccaucacgaauuuaaacgguucacccuucgacccuagugaagauauuccagcuccgcugggggugcccgacuuccagggaaggguauuuggcguuaucagccaacgggauaagcagaaugccgcuggccacaacgagccugccaaucgcgggcaugacgcaguggucccaacuuacacagcccaguacacccccaagcucggacaaauacagauugguacuuggcagacagaugaccuuaccgugaaccagccugucaaauucacgccagugggccugaaugauaccgaacacuuuaaccaauggguugugccccgauaugcuggggcguugaaucuaaacacaaaucuggcaccgucuguagccccugucuucccaggagagagacuccuguuuuucagguccuacaucccccuuaagggcgguuaugggaacccugcuauugacugccuguugccccaggagugggugcagcauuuuuaccaggaagccgcaccaucaaugagcgagguugcccucgugcgguauaucaacccugauacuggccgugcucuguucgaagccaaauuacaccgcgcaggauuuaugaccgucaguucuaauacauccgcgcccgugguagugccagcuaacggcuacuucagauuugacagcuggguuaaucaauucuauucgcuggccccgauggggacuggaaacgguaggcggcgaguccaguga

SEQ ID NO: 19068 - RNA, 1647 nt, Artificial Sequence
  derived and/or modified sequence opt3 from capsid__Norovirus__ABQ44569
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgacaaucuuagugccgcgcagauuacgaugugcccgcauguuaucguggauguccggcaacuggagcccgugaacuugccuaugccagacguacgcaauaacuucuuucacuauaaccaggggagcgauucccgacuccgucugauugccaugcuguacacaccccucagagcaaauaacucuggagacgauguuuucaccgugucguguagggucuuaacucggccuucaccagacuuuagcuucaauuuucuggugcccccgaccguggaaaguaagacaaaaccuuucacccuucccaucuugacuauauccgagaugucuaacagccgcuuuccagucccuauugauucccugcauacaucacccaccgaaaauaucguugugcagugccagaacgguagaguaacgcuagacggcgagcucauggggacuacccaacugcuuccaagucagauuugugcuuucaggggagugcugacacggagcacuucucgcgccuccgaucaggcugacaccgccacaccccgauuguucaauuauuacuggcacauccagcucgacaaccugaauggcaccccuuaugauccagcagaggacaucccgggucccuuagggacgccugauuuuagaggaaaggucuucggcguggccucacaaaggaacccagacagcacuacacgggcucaugaagcgaaaguugauaccacugcaggccguuuuacacccaagcuggggagucucgagauuucuaccgaauccgacgauuucgaccagaaucagccuacgcgcuuuaccccagugggaauaggugucgaucacgaggccgacuuccaacaguggagccuucccgauuacucgggccaguuuacacacaacaugaaucuggcuccggccguggcaccuaacuucccaggggaacaguugcuauuuuucagaucucaacugcccuccucaggaggcaggaguaaugguauccucgacugccugguaccucaggaguggguucagcauuuuuaccaggagagcgcccccgcucaaacucagguggcccuuguccgguaugugaacccagacaccgggcgaguccuguucgaagcaaaguugcacaaacucggcuuuaugacaauugcgaagaacggagauuccccuaucacugugcccccaaauggcuacuuccgcuucgagucuuggguuaacccguuuuauacccuggcuccuauggggacaggaaaugguagaaggcggauacaguga

SEQ ID NO: 19069 - RNA, 1623 nt, Artificial Sequence
  derived and/or modified sequence opt3 from capsid__Norovirus__ABQ44570
augaagauggccagcaacgacgcugcacccuccaaugauggcgccgcggggcuggugccugagucuaacaaugaagcuauggcccucgagccagucaugggagcaucacuugccgcuccgguuaccggucagacaaacaucauugaccccuggauaagaacuaauuucgugcaagcaccuaacggcgaauuuacgguaaguccaaggaauagccccggggagauccuggugaacuuggaauuaggaccugagcugaauccauaccuagcccaccucgcucggauguauaacggcuacgccggugggauggagguccaggugaugcuggcgggaaaugcauucaccgccggcaaaauuaucuuugcugccguucccccuuauuucccaguggaaaaccuuuccccgucucagauuacaauguuuccccaugucaucauagaugugcgcacucuggagccuguauugcucccaaugcccgacguucgaucgacccuguuccacuuuaaucagaaggaugaaccuaaaaugcgucugguggcaaugcucuacacaccauuaagaucaaacggcagcggggacgaugucuucaccgugaguugcaggauccugacucggcccuccccggaguuugacuucacauaucuugugccucccaccgucgagucuaagacgaaaccauuuacuuugccuguucugacccuaggagaacucagcaauucccgcuucccccugucaauugaugagauggugacaaguccaaacgaaagcaucguagugcaaccccagaacgguagagucacucuugacggcgagcuguuggggaccacacagcuccaggcuuguaauauuugcucuaucaggggaaaggugaccggccaaguuccuaacgaacagcauauguggaaucuggaggugacgaacuuaaaugguacucaguuugauccaacagacgaugucccggccccacugggggugccugacuucgcgggagagguauucggcguucucucccagcggaaccgcggcgaaucaaauccagccaaccgagcacacgacgcuguggucgccaccuacagcgauaaguauacucccaaacuugggcuggugcaaauaggaacauggaauaccaacgacgucgagaaucagccuacgaaguuuaccccaauugguuugaacgaaguggcuaauggccauagauucgagcaguggacacuacccagguacaguggggcccugacucucaacaugaaucuggcaccggccguugcuccucuuuuuccaggagaacggcuguuguucuuucguucuuacaucccccucaaaggcgguuucgggaacccugcgauugauugucuggugccccaagaguggguacagcacuuuuaucaggaguccgcacccagcuuaggcgacgucgcccuggugcgcuacguuaacccugauaccggaagagugcuauucgaagcuaagcuccacaaaggcggguuucugacagucucgucuacuuccaccggacccgugguagugccagccaaugguuauuucagguuugacucauggguuaaccaguucuacagucuugcaccgaugggcacagggaauggacggcgacgcuuucaauga

SEQ ID NO: 19070 - RNA, 1653 nt, Artificial Sequence
  derived and/or modified sequence opt3 from capsid__Norovirus__ABQ44571
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagauaacauuucugcugcccagaucacuaugugcccgcacguuauaguggacguccgccagcuugaacccgugcuguugccucucccagauauccgaaauagauuuuuccauuauaaccaggagaauacgccccguaugaggcugguggcaaugcuguacaccccucuccgggcuaacucgggcgaagacgucuuuacaguuucaugucgcguguuaacuagaccagcccccgauuucgaguuuaccuuccugguaccgccuacaguggagagcaagaccaaacccuuuacucuuccaauuuugacacugggcgaacuaaguaacuccagguucccugcggccaucgacaugcucuauaccgaucccaaugagucuauugucgugcaaccacagaacgggcggugcacgcuggacggaacucuucaggguaccacacagcugguucccacucaaaucugugcauuucgcggcaccuugauaagccagacagcucgagccgcugauuccaccgacucaccucagagagccagggaucacccacuccaugugcaagucaagaaucuggacgggacgcaguacgacccgacugaugacauucccgcaguguuaggagccaucgauuucaaaggcacaguauucgguguugcuagucagcgggacgugagcgggccucaggaacaaggacacuaugcgacccgugcacacgaggcccauauugauacuacagacccaaaguacgcucccaagcugggcaccauccucaucaaaucugaauccaacgauuuuauuacgaaucagccuauacgcuucaccccagucggcaugggggacaacaauuggagacagugggagcuucccgauuacucaggaaggcugacauugaacaugaaucuagccccggcagugagcccuaguuuuccaggugagcggauccuguucuuucgaucuauuguccccuccgccggcggguauggaagcggcuacaucgacugccucauaccucaggaaugggugcaacacuucuaucaggaggcugcccccucgcagucugcaguugcgcuggugcgcuacguaaacccagauacugguagaaauauuuuugaagcuaaacuucauagggagggguuccugaccgucgccaacuccggcaauaacccuaucgugguucccccaaauggauauuuucgguucgaagcaugggugaaccaguuuuacacauuggccccgaugggcucagggcaaggacgcagaagggcucaguga

SEQ ID NO: 19071 - RNA, 1623 nt, Artificial Sequence
  derived and/or modified sequence opt3 from capsid__Norovirus__ABQ44572
augaagauggccagcaacgacgcugcacccuccucugauggcgccgcggggcuggugccugaaaucaauaacgaagucaugccacucgacccgguugcuggagccucacuugcaacccccgugguaggucagcaaaauauuauagauccuuggaucagaaacaauuucgugcaggccccagcuggcgaguuuacagucagucccaggaacagcccuggggaaauucuguuggacuuagagcugggaccagaacuaaaucccuaccucgcacaccuggcccggauguauaacggccaugcuggugggauggaggugcagaucguucuugccggaaaugcguucacugcaggcaaaauuaucuuugccgcuauaccuccaggcuucccguacgagaaccugucccccucucagaucacgaugugcccucacgugauuaucgauguccgccaauuggaaccagugcuccugcccaugccugacauucgaaauaacuuuuuccauuauaaucaggggaacgauccaaagcugcgucucguagccauguuauacacaccccugagagcaaauaacucgggagacgauguuuuuaccgugucauguaggguccuuacuaaaccgagcccugacuucgaguuuaccuucuuggugcccccaacaguggaaaguaagaccaaacaguuuacucugccuauccuaaagauauccgagaugacaaacucucgguuccccgucccaguugaugugauguauaccgcucgcaaugagaaccagguagugcaaccccagaaugguagagucacgcucgacggcgaacugcuugggacuaccccucuguuggccgugaacauuugcaaguuuaaaggagagguuaucgcgaagaauggcgaugugaggagcuaccggauggacauggaaauuacaaacacugacgguaccccaaucgauccgacagaggacacccccgggccuaucggauccccagauuuccagggcauucucuucggcgucgccucacagcgcaauaaaaacgaacaaaaucccgcaacgcgagcucacgaggccaacauaaauacugggggagaccaguaugcuccuaagcuggcccaggugaaauuuuucagugagagccaagauuuugaaguacaucagccaacaaccuucacucccguugguguggcaggcgacaacucucacccguuuagacaguggacauuaccuagguacgggggacaccugaccaauaacacgcaucucgccccagcugucgcgccccuuuucccuggcgagcagcuguuguuuuuccggucccaaauccccucaagcggugggcacgaaaguggcuacauggauugucuagugccacaggaguggguccagcauuuuuaucaggaagcagccaccgcucaaucugagguggcccugauucguuucaucaauccugacacaggacgcguucucuuugaggcaaagcugcacaagcagggcuucauaacuguggcccacaccggggauaaccccauuguaaugccaccgaacggauacuuuagauucgaggcuugggucaaucaguucuauucccuugccccuguggguacaggcaacgggaggcggcgaguucaguga

SEQ ID NO: 19072 - RNA, 1608 nt, Artificial Sequence
  derived and/or modified sequence opt3 from capsid__Norovirus__ABQ44573
augaagauggccagcaacgacgcugcacccuccaaugauggcgccgcggggcuggugccugaggcuaacaaugaaaccauggcccucgagccagucgcaggagccucuaucgcugcaccgcuuacaggucagaacaauauuauagaccccuggaucagacugaacuucguucaagccccuaauggcgaauuuacugugucaccaaggaacagucccggggagguauuguuaaaucuggaacuaggaccugagcucaacccauaccuggcucaccuuagccggauguauaauggcuacgccggugggguggagguccaggugcuguuggcgggaaacgcauucacggccggcaaacucguuuuugcugccgugcccccucauuucccacuggaaaauauuuccccgggccagaucaccauguuuccccacgucauuaucgaugugcgcacacuggagccuguacucuuaccacugcccgacguucgaaacaauuucuuucauuauaaccagcaaaacgaaccucguaugagacuuguggcaauguuguacacuccacugaggucuaaugggucgggagaugacgucuucaccgugucaugccgggugcuaacacgccccagcccggauuuugacuucaacuaucucgucccucccaccguugagaguaagacuaaaccauuuacacugccuauacuuaccaucggugagcugacuaauuccagauuccccgugccaauugaugaauuguacacgucucccaacgagagccucguagugcagccucagaaugggaggugugcucuggacggcgaauuacagggaaccacacaacugcucccaacugccaucugcuccuuucggggccgcauuaaccagaaggucucaggugagaaucacguguggaacaugcagguuaccaauaucaacgggacaccguucgaucccaccgaagacgugccugucccacuuggaacgcccgauuucaguggcaaacuguuuggcguguugagccagcgagaccaugacaaugcguguagaucucacgaugccguaauagcaacuaacuccgcuaaguucacaccuaagcuaggggccauucaaaucggaaccugggaggagaaugacguucacauuaaccagccaacuaaauuuacacccgugggucuguucgaagaugagggcuuuaaucaguggacccucccgaacuauucaggggcucugacgcuuaacgucggacuggccccuccaguggcacccaccuucccuggcgaacaaaucuuguuuuucaggagccauaucccccucaaggguggggucgccgacccagugauugauugccuguuaccucaggaguggauacagcaccuguaccaggaaagugcucccucucaauccgacguugcgcuaauccgguuuacaaauccagauacuggccguguacucuucgaggcaaaacugcaucgcagcggauacauuaccguggccaacacaggcucgagaccgaucgucgugccugcuaauggguauuuuagguucgacucuuggguuaaccaguuuuacucccuugcccccaugggaacugguaauggccggcgacgcgugcaguga

SEQ ID NO: 19073 - RNA, 1614 nt, Artificial Sequence
  derived and/or modified sequence opt3 from capsid__Norovirus__ABQ44574
augaagauggccagcaacgacgcuacccccuccgaugacggcgcagccgggcuggugccugaaaucaauaacgaagucauggcgcucgagccaguugcuggagccucuauugcagccccggugguaggucagcaaaauauaaucgaucccuggauuagaaacaauuucgugcaggcuccugcaggcgaauuuacagucucaccaaggaacagucccggggagcuucuguuggacuuagaacugggaccugagcuaaauccauaccucgcccaccuggcucggauguauaacggccaugccggugggauggaggugcagaucguucuugcgggaaaugcauucacugccggcaaaauucuguuugcugccauacccccuagcuucccauacgaaaacuuguccccggcacagcucacgaugugcccccacgugaucgucgaugugcgccaacuggagccuguacugcucccaaugcccgacauccgaaauguguuuuaucauuacaaccagaauaacucuccuaaguuacgucugguugcuaugcuuuauaccccauugagagccaauaacucgggcgaugacgucuucacagugucauguagggugcugacucggcccagcccggauuuucaguucaccuuucuagucccucccacaguugaaaguaaaaccaagaacuucacucucccagugcugcgcguauccgagaugacaaauucuagagugccuaggugcuuugggaccaaauguauucaggcgcggaacgagaauaucauuguccaaccccagaacggacgcugcacgacugacggugaacuucugggcaccacaacuuugcagagcguguccaucuguaauuuccgagggaccaugcaggccaagcucaacgagcaaccaagauaccagcugcaguuaacaaaucuggauggaucacccauagacccuaccgaugacaugccagcaccgcucggcacgcccgacuuucaagcuaugcuuuaugguguugccagucagaggagcucucgggauaacgcuacucgugcccacgacgcacagauugauacagccggggacaccuucgcuccuaagaucggacaggugcgcuucaaauccucaagcggcgauuuugaccugcaugauccaacuaaguucacacccauuggcgucaauguggacgaucaacacccuuuuagacaguggaguuugccaaacuacgggggacaccuagcgcugaauaaccaucucgcacccgccguaaccccgcuguucccuggugaacagauccuguuuuucaggucucacaucccauccgcuggcgggcauacggacggagccauggauugccuuuugccccaggaguggauugaacacuuuuaccaagaggcagccccuagccagucggacauagcucucguucgguucaucaaucccgacaccggccgagugcuguuagaggccaaacugcacaagcaggguuuucuaacagucgcagcgucuggggaucauccaauugugaugccuacuaacggcuauuuccgcuuugaggcuugggucaaucccuucuacacccucgccccagugggaacaggcuccgggagaaggcggauccaguga

SEQ ID NO: 19074 - RNA, 1641 nt, Artificial Sequence
  derived and/or modified sequence opt3 from capsid__Norovirus__ABQ44575
augaagauggccagcaacgacgcugcacccuccaaugauggcgccgcgucucuggugccugaggggauuaacgaaaccaugccacucgagccggucgcuggagccucaauugcagcccccguugcuggucagacaaauauaaucgacccuuggauuagaacuaacuucgugcaagcaccaaauggcgaauuuacgguaagucccaggaacagcccuggggagauccuucugaauuuggaauuaggaccagaucugaaccccuaccuagcccaccucucccggauguauaauggcuacgcuggugggguggagguccaggugcugcuugccggaaacgcguucaccgcaggcaaaauucuguuugccgcuaucccuccaaauuucccgguugacaugauaucucccgcccagaucacaauguugccucaucucauuguggauguccgcacucuggagccaaucaugauuccccugccugacgugcgaaacguauuuuaucacuucaauaaccagccacaaccccguaugagacucguugcaauguuauacaccccgcugaggucgaauggcucaggggaugacguguuuacagucagcugccgggugcuuacccgcccuacucccgauuucgaauuuaucuauuuggugccaccuagugucgaguccaagacaaaacccuucacccugccaauacuaacgauuucugaacucacuaacagcagauuucccaucccuauugagcagcuguacaccgcuccaaacgagacaaauguugugcagugucagaacggaaggugcacucuugacggugaacugcaaggcaccacacaguugcucuccucagccguauguaguuaucgggggcgcaccguggcgaauaacggagauaauugggaccagaaccuguuacagcugacguacccgaauggcgccagcuacgaucccacugacgaggucccugcaccacucgguacacaagacuucucugggaugcuuuauggagugcugacccaggauaacguuaauguguccacuggcgaagcuaagaacgccaaaggcaucuacaucucaacaaccagcgggaaguuuacgcccaagauuggaaguauagguuugcauucuaucaccgagcacguccauccuaaucagcaaucccgauucacaccagugggcguagcuguuaacgaaaauacucccuuccagcagugggugcuaccgcacuaugccgggagccuggcacucaacaccaaucuggccccugcugucgcgccaacauuucccggagagcagcuucuguucuuuagaucgagggugccuugcguccaaggcuugcagggucaggacgcauucauugauugucuccugccccaggagugggugaaccacuuuuaccaagaagccgcuccagccccugcacccucucaggccgacguugcuuuaauccgguaugugaacccagauacugggcguacccuguucgaggccaaacuacaucgcuccggcuuuauaacaguaucacacaccggagcauacccgcucgucgugccucccaauggccauuucagauuugacaguuggguuaaccaguucuauagccuggcgccaauggggacuggaaaugguaggcggcgaauccaguga

SEQ ID NO: 19075 - RNA, 1623 nt, Artificial Sequence
  derived and/or modified sequence opt3 from capsid__Norovirus__ABQ44576
augaagauggccagcaacgacgcugcacccuccaaugauggcgccgcggggcuggugccugaggucaacaaugaaacccucgcucuugagccaguugccggagcaucuaucgccgcuccgcugacaggucagaacaaugugauugaccccuggauaagauugaacuucguacaagcaccuaauggcgaauuuacugugucaccaaggaacagucccggggagaucuuacugaaucuagaacucggaccugagcugaacccauaccuugcccaccuggcucggauguauaauggcuacgccgguggggucgaggugcagguuuugcucgcgggaaacgcauucacggccggcaaacugguguuugcugccauucccccucauuucccagucgauaaucugagcccgggccagaucaccauguuuccccacgugauuaucgacguacgcacacucgaaccuguuuuacugccacuucccgaugugcgaaacuccuucuuucauuauaaucagcaaucugaccagcguaugagauugauagcaaugcuguacacuccucuaaggucgaacgggucaggagaugacgucuucaccgugagcugccgggugcucacacgcccaagucccgauuuugacuucaacuaucuggucccgccuaccguugaguccaagacuaaacccuuuucugugccaguacuuacacugaaugaauugaccaacagcagauucccugugcccaucgaugcuauguacacguccccaaaugacucaauugucgugcagccccagaacgguagggccacuaucgauggcgagcuccuggggaccacacaauuaauuccuaguggaaucuguagcuuucggggcaagauaacuacccaccugucugacgaccgccaucucuggaauauucagguuacaaaccuuaaugguaccccauucgauccgacggacgaugugcccgcgccucuggggaugccagacuucuccggacagaucuuuggcgucgugucacagcgagauacuggcacaaaccccgccaauagagcacacgacgcuguauuggccaccuauagcgcuaaauacacuccuaagcuagggaguguucaaauuggaacaugggauaccgaggaccugcucgaaaggcagccagugaaguucacgcccgucggucugaacgagaucggccaggauaaacacuuugaccaaugggugcuuccgaauuacucuggggcccugggauugaacaugcaucucgccccugcagucuccccacuguuccccggcgaacgguuacuguuuuuccguagcuauaucccucuaaagggugggcacggcgaucccuuuauugacugccucgugccacaggaguggauacagcauuucuaccaggaaucggcuccugcgcaaucuuccguugcacugcuucgcuaugugaaucccgacaccggaagaacauuguuugaggccaaacugcacaaggagggcuucaucacuguaucaaguaccgaaaacaggccagucgugguuccgccuaauggguacuuucgguucgauagcugggugaaccaguuuuauucccucgcucccaugggaacagguaacggccgacgcagaaugcaguga

SEQ ID NO: 19076 - RNA, 1569 nt, Artificial Sequence
  derived and/or modified sequence opt3 from capsid__Norovirus__ACJ04900
augaagaugaccgacagagauacaaucgacagcgcccccgcucugggccaggugcucccuccagaggucgaagcauccguuccgguggagcccacugccggggcgccuguagcugccccaacggcaggacaagugaaccccauugauccuuggauauucgccaauuuuguccaggcuccacagggugaguucaccaucucucccaacaauaacccuggcgaaauucuuuuugaacuggaguuggggccagacuuaaauccguaccuggcacaccuaaggcggauguauaacggauggacaggcucaaugcgcgugcgaguucuccuggccgguaaugcuuucagugccgggaaaguggucguguuuugcguacccccuggauucgauacuagcuaccuuaccccaucccaggcgacacaauuuccccauguucugaucgacgugcgugcaccugagccagucgaaaugcccuuggaggaugugagaaacauucucuuccaccagggcccggacucuaggaugcggcugaugggcaugcuguauaccccucuccgcgccaauucgggggcugaucccuuuguggucacuggaagaguuuuaacauguccaucaccuaacuucagcuuuuucuuucuggugcccccaaccguagaagagagggagacgcccuucacucuuccuaauuugccagugaacagucugucccauucucgggccauggaaccgaucgcacagaugaugagcucccgcaauuuccccgcuucaguccaguuucaaaacggucgaugcacccuaaguggcgaccuccuggggacaacuccuagcucuccagccgaugugggaaccuucguuggccuuauagcggagcccgguucccacguggucgaacugucacagccuaaucaggaggacuuucaugccgggagcgcaccagcucccuucggauuuccggauuucagugacuguucuuugacauuugugguagccuccgcuagcaccguuggcgaaagaacggugaacacuaggucgccucagaacuucacaccagcccucggccacaucaccuuugacgaggaggcacccgccgaucuguuccgggcucacuuacguaaucugugggacccuacugaacauucuuuuuggcgcauucccgauuacagagcggacguccucgggggagaguucgcaccauccgugucagccccuggugucggcgaaacacuucuguuuuucaugugcaacgugcccaggaguaauggggcuaacccaaauccguguccuugcuugcuaccccaagaguggaucacccacuucguuagcgaacgggccgcacugcaguccgauguggcccuccugaacuauauuaauccaaacacgggacgaguacuuuuugaguguaagcuguacgcuaauggcuucuugaccgucaaccucggugccucugaccaggcaacacugcccguggaugggaucuuuaaauucguuagcugggugucauuuuauuaccaauuacgcccugucggcaauauaggagugggcagaaggcugccacggcuagacggguucuga

SEQ ID NO: 19077 - RNA, 1569 nt, Artificial Sequence
  derived and/or modified sequence opt3 from capsid__Norovirus__ACJ04903
augaagaugaccgacagagauacaaucgacagcgcccccgcucugggccaggugcucccuccagaggucgaagcauccguuccgguggagcccacugccggggcgccuguagcugccccaacggcaggacaagugaaccccauugauccuuggauauucgccaauuuuguccaggcuccacagggugaguucaccaucucucccaacaauaacccuggcgaaauucuuuuugaacuggaguuggggccagacuuaaauccguaccuggcacaccuaaggcggauguauaacggauggacaggcucaaugcgcgugcgaguucuccuggccgguaaugcuuucagugccgggaaaguggucguguuuugcguacccccuggauucgauacuagcuaccuuaccccaucccaggcgacacaauuuccccauguucugaucgacgugcgugcaccugagccagucgaaaugcccuuggaggaugugagaaacauucucuuccaccagggcccggacucuaggaugcggcugaugggcaugcuguauaccccucuccgcgccaauucgggggcugaucccuuuguggucacuggaagaguuuuaacauguccaucaccuaacuucagcuuuuucuuucuggugcccccaaccguagaagagagggagacgcccuucacucuuccuaauuugccagugaacagucugucccauucucgggucauggaaccgaucgcccagaugaugagcucccgcaauuuccccgcaucagugcaguuucaaaacggucgaugcacccuaaguggcgaccuccuggggacaacuccuagcucuccagcugaucuuggaaccuucguuggccugauagccgagcccgguucccacguggcggaauugucacagccuaaucaggaggacuuucaugccgggagcgcaccagcucccuucggauuuccggauuucagugaauguucucucacauuugucguggccuccgcuagcaccguaggcgagagaacgguuaacacuaggucgcugcagaacuucaccccugccuuaggccacaucacauuugacgaggaagcaccagccgaccuguuccgggcucaccuccguaaucuuugggaucccacugagcauucuuuuuggcgcauuccugacuacagagcggaugugcugggaggggaguucgcacccuccgucucagccccaggugugggcgaaacauugcuauuuuucaugugcaacgucccuaggcugaauggggcuaaccccaauccauguccgugccuccugccucaagaauggaucacccacuucgugagugagcgggccgcacuucagagcgacguugcccuguugaacuauauuaaucccaacacgggacgagugcucuuugaguguaagcuguacguaaauggcuucuuaaccgucaaccugggugcuuccgaucaggccacacuaccaguggacgggaucuuuaaauucguuucuugggugagcuuuuauuaccaacuccgccccgucggcaauauaggagugggcagaaggcugccucggcuugauggguucuga

SEQ ID NO: 19078 - RNA, 1569 nt, Artificial Sequence
  derived and/or modified sequence opt3 from capsid__Norovirus__ACJ04906
augaagaugaccgacagagaugugacagacagcgcccccgcucugggccagguccucccuccagagguugaagcauccgugccgguagagcccacugccggggcgccuguggcugccccaacggcaggacaagucaaccccaucgauccuuggauuuucgccaauuuugugcaggcuccacagggugaguucaccauaucucccaacaauaacccuggcgaaauccuuuuugaacuggaguuggggccagacuuaaauccguaccuggcacaccuaaggcggauguauaacggauggacaggcucaaugcgcguucgagugcuccuggccgguaaugcuuucagugccgggaaagucgugguauuuugcguucccccuggauucgauacuagcuaccuuaccccaucccaggcgacacaauuuccccaugugcugauugacguccgugcaccugagccaguggaaaugcccuuggaggaugugagaaacauccucuuccaccagggcccggacucuaggaugcggcugaugggcaugcuguauaccccucuccgcgccaauucgggggcugaucccuuugucguuacuggaagaguguuaacauguccaucaccuaacuucagcuuuuucuuucugguacccccaaccguggaagagagggagcccccuuucacgcuuccaaauuugccggucaacaaucugagucauucccgggugauggaacccauugcccagaugaugucuagccgcaacuucccugcauccguucaguuucaaaauggucgaugcacucuaucaggcgaccuccuggggaccacaccaaguagccccucugaucuuggagcuuucgugggccugaucgccgagccugguuccagagucguggaauugucacagccaaaccaggaggacuuucacgcggggagcgcccccgcaccguucggauuuccugauuucagugacuguucucucacuuuuguaguugcuuccgccaccacagugggcgaaaggaccgucaacgcucggagcccacagaauuucacgcccgcccugggccauauaacuuuugacgaggaggccccugcagauuuauuccgugcucaucugcgcaaccucugggaccccacagaacacucguuuuggagaaucccagauuacagggcggacgugcuugggucugaguucgcaccuuccgucucagcccccggagugggugaaacccuguuguuuuucaugugcaauguuccacggcuaaacggcgcuaauccgaacccuugucccugccugcucccacaagaguggauuacucacuucgugagugaacgagccgcacugcagagcgauguagcccuucugaauuaugucaaccccaauacagggcgcguguuguuugaggcuaagcucuacgccaacggauuccugaccguuaauuuaggcgcauccgaccaggcgacgcugccuguggaugguaucuuuaaauucgucucuugggugagcuuuuauuaccaacuaagaccaguagggaacgcuucagugggcaggcggcucccccgccuggacggauucuga

SEQ ID NO: 19079 - RNA, 1623 nt, Artificial Sequence
  derived and/or modified sequence opt3 from capsid__Norovirus__ACY00565
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagucagguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguuccuaaugugcaccuggcaccagccguagcucccaccuuuccuggugagcaguuacuguucuuuaggagcacuaugcccggguguucgggcuauccaaacgucgaucucgacugccuucugccucaggagugggugcagcauuucuaccaagaagcggcacccgcccagucugauguugcuuugcuacgguuugugaauccagacacgggacguguccuguucgaguguaaacuccacaaguccggcuaugugacaguagcccauaccgggcagcacgaucuggugauuccgccuaacggauacuuucgcuucgacucauggguuaaccaguucuauacucuugcacccauggguaauggcaccgggagaaggcgggcccuguga

SEQ ID NO: 19080 - RNA, 1623 nt, Artificial Sequence; identical to SEQ ID NO: 18906
  derived and/or modified sequence opt3 from capsid__Norovirus__ACY00568

SEQ ID NO: 19081 - RNA, 1623 nt, Artificial Sequence
  derived and/or modified sequence opt3 from capsid__Norovirus__ACY00571
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccaacuuaagccaccuggcccggauguacaauggcuaugcggguggguucgaagugcaggucauucuagcaggaaacgccuuuacagcuggcaaaaucauuuucgccgcagugccuccaaauuuuccgacugagggccucucccccucucagguaacgauguucccucauaucauaguugacgugcgccaacuggagccaguccuuaucccccugccugaugugcgaaacaauuuuuaccacuauaaccagucgaacgacucaaccauuaaguugaucgcuaugcucuacacaccacugcgugccaauaacgcgggggaagauguguucacugucagcugcagaguucugaccaggcccaguccggacuuugauuucauuuuucucgugccucccacaguagagucccggaccaaaccauucacugugccuaucuuaacagucgaagagaugaccaauucucgcuuucccauaccacuggagaaacuuuucacgggacccagcuccgccuucgugguucagccucagaacgguagauguacuaccgacggcguguugcuggggacaacucaacuaucaccagucaauauuugcaccuuuaggggagaugugacacauaucgcaggcagucggaacuauaccaugaaucucgcuagccugaacuggaauaacuacgacccgacggaagagauucccgccccucuugguacuccagauuucguagggaagauccagggaguucugacacagaccacuaagggcgacggcucuacacgcgggcacaaggcuaccguguauacgggauccgcccccuuuaccccuaaauuggguucaguccaguucagcacagacacugaaaaugauuuugagacccaucaaaacacaaaguucacuccagugggcgucauccaggacgggggaaccacacaccgaaaugaaccccagcaaugggugcucccgaguuacucuggcagaaacguucagaaugugcaccuggccccugcaguagcuccaaccuuucccggugagcaguuacuguucuuuagguccacuaugccuggguguagcggcuaccccaacauggaucucgacugccuucugccacaggaguggguccaacauuucuaucaggaagcggccccugcacagucggauguggcuuugcuacgguuuguuaaccccgacacgggacgugugcuguucgaguguaaacuccacaagucuggcuacgucacaguggcccauaccgggcagcacgaucugguaauuccaccgaauggauauuuucgcuucgacuccugggugaaccaauucuacacucuugcaccuauggguaauggcaccgggagaaggcgggcccuguga

SEQ ID NO: 19082 - RNA, 1623 nt, Artificial Sequence
  derived and/or modified sequence opt3 from capsid__Norovirus__ACY00573
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguucacggaauuacaccaugaaccucgcuagucugaauuggaacaauuaugacccgacggaagagauucccgccccucuugggacuccagauuucguaggaaagauccagggcguucugacacagaccacuaagggcgacgggagcacacgcggacacaaggcuaccguguacacggguucugcccccuuuaccccuaaauugggcuccguccaguucucaacagacacugaaaacgauuuugagacccaucaaaauacaaaguucacuccagugggggucauccaggacggaagcaccacacaccgaaacgaaccccagcaaugggugcucccgaguuacucuggcagagauguucacaaugugcaucuggccccugcaguagcuccaaccuuucccggugagcaguuacuguucuuuagguccacuaugccuggguguagcggcuaucccaacauggaccucgauugccuucugccacaggaguggguccagcacuucuaccaagaagcggccccugcacagucggacguggcuuugcuacgguuuguuaaucccgauacgggacgugugcuguucgaguguaaacuccauaagucuggcuaugucacaguggcccacaccgggcagcacgaccugguaauuccaccgaacggauacuuucgcuucgauuccugggugaaccaguucuauacucuugcaccuauggguaauggcaccgggagaaggcgggcccuguga

SEQ ID NO: 19083 - RNA, 1623 nt, Artificial Sequence
  derived and/or modified sequence opt3 from capsid__Norovirus__ACY00576
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcacccacaauuacacgaugaaccucgcuagucugaauuggaacaauuaugacccgacugaagagauucccgccccucuugguacaccagauuucguagggaagauccagggaguucugacccagacuacaaagggcgacggcagcacccgggggcauaaggcuacgguguacaccggaucugcccccuuuacaccuaaauuggguuccguccaguucucaacugacaccgaaaacgauuuugagacacaccaaaauacuaaguucaccccagugggcgucauccaggacgggagcacaacccaccgcaacgaaccccagcaaugggugcucccgaguuacucuggaggcaauguucagaacgugcaucuggccccugcaguagcuccaacuuuucccggugagcaguuacuguucuuucgauccacgaugccuggguguagcggcuaucccaauauggaucucgacugccuucugccacaggaguggguccaacacuucuaccaggaagcggccccugcacagucggauguggcuuugcuaagauuuguuaaccccgacacaggaagggugcuguucgaguguaaacuccauaagucuggcuaugucaccguggcccacacugggcagcacgaucugguaauuccaccgaacggauacucccgguuugacccuugggugaaucaauucuauacccuugcacccauggguaacggcacagggcgucgcagagcccuguga

SEQ ID NO: 19084 - RNA, 1623 nt, Artificial Sequence
  derived and/or modified sequence opt3 from capsid__Norovirus__ACY00579
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuccacagcuggcaaaaucauuuuugccgcagugccuccaaacuucccgacugagggccucucucccucgcagguaacgauguuuccucauaucauaguugacgugcgccaacuggagccaguccuuaucccccugccugaugugcgaaauaacuucuaucacuacaaucagucaaacgacagcaccauuaaguugaucgcuaugcucuauacaccacugcgugccaacaaugcgggggaagauguguuuacugucaguugcagaguucugaccaggcccuccccggacuucgauuuuauuuuccucgugccucccacaguagagucucggaccaaaccauuuacugugccuaucuuaacagucgaagagaugaccaacagccgcuuccccauaccacuggagaaacuuuuuacgggacccuccucagccuucgugguucagccucagaaugguagauguacuaccgacggcguguugcuggggacaacucaacuaaguccagucaacauuugcaccuucaggggagaugugacacauaucgcaggcacccacaauuacacgaugaaccucgcuagccugaauuggaacaauuaugacccgacugaagagauucccgccccucuugguacaccagauuuuguagggaagauccagggaguucugacccagacuacaaagggcgacggcucuacccgggggcauaaggcuacgguguacaccggauccgcccccuucacaccuaaauuggguucaguccaguuuagcacugacaccgaaaacgauuucgagacacaccaaaauacuaaguuuaccccagugggcgucauccaggacgggaguacaacccaccgcaacgaaccccagcaaugggugcucccgucuuacuccggaggcaauguucagaacgugcaucuggccccugcaguagcuccaacuuuccccggugagcaguuacuguuuuuccgaagcacgaugccuggguguucgggcuaucccaauauggaucucgacugccuucugccacaggaguggguccaacacuuuuaccaggaagcggccccugcacagucugauguggcuuugcuaagauucguuaaccccgacacaggaagggugcuguuugaguguaaacuccauaaguccggcuaugucaccguggcccacacugggcagcacgaucugguaauuccaccgaacggauacuuccgguuugacucaugggugaaucaauucuauacccuugcaccuauggguaacggcacagggcgucgcagagcccuguga

SEQ ID NO: 19085 - RNA, 1623 nt, Artificial Sequence
  derived and/or modified sequence opt3 from capsid__Norovirus__ACY00582
augaagauggccagcaacgacgcuaaucccuccgauggcucuguggcaaaccuggucccugagguuaauaacgaagugauggcccucgagccaguagugggggcggcuaucgccgcaccggucgccggacagcaaaaugugauugaccccuggauaagaaacaauuucguucaggcuccugguggcgaauuuaccgugucaccaaggaacgcacccggggagauccuuuggagugccccucugggaccagauuugaaucccuacuuaagccaccuggcucggauguauaacggcuacgccgguggguucgaaguccaggugauucuagcgggaaaugcauuuacagccggcaaaaucauuuucgcugccguaccuccaaacuuuccgacugagggccucucccccucucagguuacgauguucccucauaugaucguggacguccgccaacuggagccagugcuuauaccccugccugaugugcgaaauaacuuuuaucacuacaaucagucgaacgacucaaccaucaaguugauugcaaugcucuauacaccacugcgugcugauaacgccggggaagacgucuucacuguuagcugcagagugcugaccaggcccaguccggauuuugacuucaucuuucucguaccucccacaguggaguccaaaaccaagccauucacugucccuauuuuaacaguggaagagaugaccaauucucgguuucccaucccacuggagaaacuuuucacgggacccagcuccacuuucguugugcagccucagaacggucgcuguaccacagauggcgucuugcuggggacuacccaacuaucaccagugaauauaugcacauuuagaggagacguaacccauauugcgggcaguaggaacuacacgaugaaucucgccagccugaacuggaauaacuaugauccgacugaagagauccccgcaccucuugguacaccagacuucguugggaagauucagggagugcugacccagacuacaaagggcgacggcucuacccgggggcacaaagcuacggucuacaccggauccgcccccuuuacaccuaaguuggguucagugcaguucagcacugauaccgaaaaugacuuugagacacaucaaaacacuaaauucaccccagucggcgugauccaggaugggaguacaacccaccgcaaugaaccccagcaauggguucucccgucuuacuccggacgaaacgugcacaauguacaucuggcuccugccgucgcaccaacuuuucccggcgagcaguuacuguucuuuagaagcacgaugccugguuguucgggguaucccaacauggaccucgauugccuucugccacaggagugggugcagcacuucuaccaagaagccgcuccugcgcagucugacguugcauugcuaagguuugugaaucccgauacaggccggguccuguucgaguguaagcuccauaaauccggauaugugaccguagcccacacuggccagcacgaccuggugaucccaccgaacggguacucacguuuugauaguuggguuaaccaguucuauacccuugcuccuaugggaaaugguacaggccgcagaagggcccuguga

SEQ ID NO: 19086 - RNA, 1623 nt, Artificial Sequence
  derived and/or modified sequence opt3 from capsid__Norovirus__ACY00588
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggcaauucuagccggaaaugcuuuuacagccggcaaaaucauuuucgcagcugucccuccaaacuuuccgacugagggccucucccccucucaggugacgauguucccucauaucauaguagacguucgccaacuggagccagugcuuaucccccugccugauguccgaaauaacuuuuaucacuacaaucagucgaacgacucaaccauuaaguugaucgccaugcucuauacaccacugcgugcgaacaaugccggggaagauguguucacugugagcugcagaguccugaccaggcccaguccggacuuugauuucauuuuucucguuccucccacaguggagucccggaccaaaccauucacuguaccuaucuuaacaguggaagagaugaccaacucucgcuuucccauaccacuggagaagcuguucacgggacccagcuccgcauucgucgugcagccucagaaugguagauguacuaccgacggcguuuugcuggggacaacucaacuaucaccagugaacauuugcaccuuuaggggagaugucacacauaucgcuggcagucggaauuacaccaugaaccucgccagccugaauuggaacaauuaugacccgacggaagagauucccgcuccucuugguacuccagauuucguggggaaaauccagggaguacugacacagaccacuaagggcgacggcucuacacgcgggcacaaggccaccguuuacacgggauccgcacccuuuaccccuaaauuggguucacuccaguucagcacagacacugaaaacgauuuugagacccaucaaaauacaaaguucacuccagugggcgucauccaggacgggggaaccacacaccgaaacgaaccccagcaaugggugcugccgaguuacucuggcagaaaugucccuaacgugcacuuagccccagcuguugcgcccaccuuuccuggugagcagcuucucuucuuuagguccacuaugcccggguguagcggcuauccaaauauggaucuugacugccuguugccucaggagugggugcagcauuucuaccaagaagcagcccccgcucagucggauguagcccuacugcgguuugucaacccagacacgggacguguucucuucgaguguaaacugcacaagucuggcuaugugacaguggcacauaccgggcagcacgaucuugucauuccgccuaacggauacuuucgcuucgacuccugggugaaucaguucuauacucuggcccccauggguaacggcaccgggagaaggcgggcuuuguga

SEQ ID NO: 19087 - RNA, 1623 nt, Artificial Sequence
  derived and/or modified sequence opt3 from capsid__Norovirus__ACY00594
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagccaaacgacucgaccauuaaguugaucgcuaugcucuauacaccccugcgugccaacaaugcgggggaagauguguucacugucucaugcagaguucugaccaggccgagcccugacuuugauuucauuuuucucgugcccccaacaguagagagucggaccaaaccuuucacugugcccaucuuaacagucgaagagaugaccaacucccgcuuuccaauaccccuggagaaacuuuucacgggaccuucuagcgccuucgugguucagccacagaaugguagauguacuaccgacggcguguugcuggggacaacucaacuauccccggucaacauuugcaccuuuaggggagaugugacacauaucgcaggcucacggaauuacaccaugaaccucgcuagucugaauuggaacaauuaugaccccacggaagagauuccugccccacuugguacucccgauuucguagggaagauccagggaguucugacacagaccacuaagggcgacggcagcacacacgggcauaaggcuaccguguacacgggaucugccccuuuuaccccaaaauuggguuccguccaguucucaacagacacugaaaacgauuuugagacccaccaaaauacaaaguucacucccgugggcgucauccaggacgggagcaccacacaccgcaacgaaccgcagcaaugggugcucccuaguuacucuggacgaaauguucagaacgugcaucuggcaccagccguagcucccaccuuuccuggcgagcaguuacuguucuuuagauccacuaugcccgguuguagcggguauccaaauauggaucucgacugccuucugccucaggaguggguccaacacuucuaccaggaagcggcacccgcccagucggauguggcuuugcuaagguuuguuaacccagacacgggccgggugcuguucgaguguaaacuccauaagucuggauaugucacaguggcccacaccggccagcacgaucugguaauuccgccuaacggguacuuucguuucgacuccugggugaaucaauucuauacucuugcacccaugggaaacgguaccggccgcagaagggcccuguga

SEQ ID NO: 19088 - RNA, 1623 nt, Artificial Sequence
  derived and/or modified sequence opt3 from capsid__Norovirus__ACY00597
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguuggggugcgccaacuggagccaguccuuaucccccugccugacgugcgaaauaacuuuuaucacuacaaucagucgaacgauucaaccauuaaguugaucgcuaugcucuauacaccacugcgugccaacaaugcgggagaagacguguucacugucagcugcagaguucugaccaggcccaguccggauuuugacuucauuuuucucgugccucccacaguagagucccggaccaaaccauucacugugccuaucuuaacagucgaagagaugaccaacucucgcuuucccauaccacuggagaaacuuuucacgggucccagcuccgccuucgugguucagccucagaauggcagauguacuaccgaugggguguugcugggaacaacucaacuaucaccagucaacauuugcaccuuuaagggcgacgugacacauaucgcagguaguaggaauuacaccaugaaccucgcuagccugaauuggaacaauuaugauccgacggaagagauucccgccccucuugggacuccagacuucguaggaaagauccagggcguucugacacagaccacuaagggcgaugggucuacacggggacacaaagcuaccguguacacggguuccgcccccuuuaccccuaaguugggcucaguccaguucagcacagacacugaaaacgacuuugagacccaucaaaauacaaaauucacuccagugggggucauccaggauggaggcaccacacaccgcaacgaaccccagcaaugggugcucccgaguuacucuggucgaaauguucagaacgugcaccuggccccugcaguagcuccaaccuuucccggggagcaguuacuguucuuuagauccacuaugccuggcuguagcggauaucccaauauggaccucgauugccuucugccacaggaguggguccaacauuucuaccaggaagcggccccugcacagucggacguggcuuugcuaagguuuguuaaccccgauacgggccgggugcuguucgaguguaagcuccacaaaucuggguaugucacaguggcccauaccggacagcacgaccugguaauuccaccgaacgguuacuuucguuucgauuccugggugaaucaauucuauacucuugcaccuaugggcaacgggaccggacgcagaagggcccuguga

SEQ ID NO: 19089 - RNA, 1623 nt, Artificial Sequence
  derived and/or modified sequence opt3 from capsid__Norovirus__ACY00600
augaagauggccagcaacgacgcuaaucccuccgauggcccugcagccaaccuggugccagaggucaauaacgaaguuauggcgcucgagccggugguaggggcugccaucgcagcccccguggcuggacagcaaaaugucauugacccuuggauaagaaacaauuucgugcaggcaccagguggcgaauuuaccguuucucccaggaacgccccuggggagauccuuuggucagcuccacugggacccgauuugaauccuuacuuaagucaccuggcccggauguauaacggcuacgcggguggguucgaagugcaggucauucuagcaggaaaugccuuuacagcuggcaaaaucauuuucgccgcagugccaccgaacuuucccacugagggccucagcccuucccagguaacgauguucccacauaucauaguugacgugcgccaacuggagcccguccuuaucccucugccagaugugcgaaauaacuuuuaucacuacaaucagucuaacgacucgaccauuaaguugaucgcuaugcucuauacaccccugcgugccaacaaugcgggggaagauguguucacugucucaugcagaguucugaccaggccgagcccugacuuugauuucauuuuucucgugcccccaacaguagagagucggaccaaaccuuucacugugcccaucuuaacagucgaagagaugaccaacucccgcuuuccaauaccccuggagaaacuuuucacgggaccuucuagcgccuucgugguucagccacagaaugguagauguacuaccgacggcguguugcuggggacaacucaacuauccccggucaacauuugcaccuuuaggggagaugugacacauaucgcaggcucaaguaauuacaccaugaaccucgcuagccugaauuggaacaauuaugaccccacggaagagauuccugccccacuugguacucccgauuucguagggaagauccagggaguucugacacagaccacuaagggcgacggcucuacacgggggcacaaggcuaccguguacacgggauccgccccuuuuaccccaaaauuggguucaguccaguucagcacagacacucaaaacgauuuugaaacccaucagaauacaaaguucacucccgugggcgucauccaggacgggggaaccacacaccgcaacgagccgcaacagugggugcucccuaguuacucuggccgaaauguucagaacgugcaccuggcaccagccguagcucccaccuuuccuggugaacaguuacuguucuuuagauccacuaugcccggguguagcggcuauccaaauauggaucucgacugccuucugccucaagaguggguccagcauuucuaccaggaggcggcacccgcccagucggauguggcuuugcuaagguuuguuaacccagacacgggacgggugcuguucgaauguaaacuccacaagucucguuaugucacaguggcccauaccggccaacacgaucugguaauuccgccuaacggguacuuucgcuucgacuccugggugaaucaguucuauacucuugcacccaugggaaacgguaccggcagaaggcgggcccuguga

SEQ ID NO: 19090 - RNA, 1623 nt, Artificial Sequence
  derived and/or modified sequence opt3 from capsid__Norovirus__ACY00603
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugcccucacagcuggcaaaaucauuuuugccgcagugccuccaaacuucccgacugagggccugucccccucucagguaacgauguuuccucauaucauaguugacgugcgccaacuugagccaguccugauccccuugccugaugugcgaaauaacuucuaucacuacaaucagucgaacgacucaaccauuaagcucaucgcuaugcuguauacaccacugcgugccaacaaugcgggggaagauguguuuacugucagcugcagaguucucaccaggcccaguccggacuucgauuuuauuuucuuagugccucccacaguagagucccggaccaaaccauuuacugugccuauccugacagucgaagagaugaccaacucucgcuuccccauaccacuugagaaguuguuuacgggacccagcuccgccuucgugguucagccucagaaugguagauguacuaccgacggcgugcugcuagggacaacucaacucucaccagucaacauuugcaccuucaggggagaugugacacauaucgcaggcagucggaauuacaccaugaaccuggcuagccuuaauuggaacaauuaugacccgacggaagagauucccgccccucuggguacuccagauuuuguagggaaaauccagggaguucccacacagaccacuaagggcgacggcucuacacgcgggcacaaggcuaccguguacacgggauccgccccuuucaccccaaaauuggguucaguccaguuuagcacagacacugaaaacgauuucgaggcacaucaaaauaccaaguuuacacccgugggcgucauccaggacgggggaacuacccaccgaaacgaaccgcagcaaugggugcucccuaguuacucuggcagaaauguuccaaacgugcaccuggcccccgcuguagcgccuacauuccccggugagcaguuacuguuuuucagguccaccaugccaggguguagcggcuauccuaauauggaucucgacugccuucugccccaggaguggguccagcauuuuuaccaagaagcagccccagcucagucggauguggccuugcuacgguucguuaacccggacacuggacgugugcuguuugaguguaaacuccacaagucuggcuaugucacgguggcacauacagggcagcacgaucugguaauuccucccaacggauacuuccgcuuugacuccugggugaaucaguucuauacccuugccccaauggguaacggcacugggagaaggcgggcucuguga

SEQ ID NO: 19091 - RNA, 1623 nt, Artificial Sequence
  derived and/or modified sequence opt3 from capsid__Norovirus__ACY00606
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcagaugauucuagcaggaaaugccuuuacagcuggcaaaaucauuuucgccgcagucccuccaaacuuuccgacugagggccucucccccucucaggugacgauguucccucauaucauaguagacguucgccaacuggagccagugcuuaucccccugccugauguccgaaauaacuuuuaucacuacaaucagucgaacgacucaaccauuaaguugaucgcuaugcucuauacaccacugcgugccaacaaugcgggggaagauguguucacugugagcugcagaguccugaccaggcccaguccggacuuugauuucauuuuucucguuccucccacaguggagucccggaccaaaccauucacuguaccuaucuuaacaguggaagagaugaccaacucucgcuuucccauaccacuggagaaacuuuucacgggacccagcuccgccuucgucgugcagccucagaaugguagauguacuaccgacggcguuuugcuggggacaacucaacuaucaccagugaacauuugcaccuuuaggggagaugucacacauaucgcaggcagucggaauuacaccaugaaccucgcuagccugaauuggaacaauuaugacccgacggaagagauucccgccccucuugguacuccagauuucguggggaagauccagggaguacugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggggaaccacacaccgaaacgaaccccagcaauggguccucccgaguuacucuggcagaaaugugccuaacguucaccuggcaccagccguggcucccaccuuuccuggugagcaguuacuguucuuuagguccacuaugcccggguguagcggcuauccaaauauggaucucgacugccuucugccucaggaguggguacagcauuucuaccaagaagcggcacccgcccagucggaugucgcuuugcuacgguuugugaacccagacacgggacguguucuguucgaguguaaacuccacaagucuggcuaugugacagucgcccauaccgggcagcacggacuggugauuccgccuaacgguuacuuucgcuucgauuccuggguaaaucaguucuauacucuugcacccaugggcaacgggaccggaagaaggcgggcccuguga

SEQ ID NO: 19092 - RNA, 1623 nt, Artificial Sequence
  derived and/or modified sequence opt3 from capsid__Norovirus__ACY00609
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacggaccccagcuccgccuucgugguucagccucagaauggaagauguacuaccgaugguguguugcugggcacaacucaacuaucaccagucaacauuugcaccuuuaggggagacgugacacauaucgcagggagucggaauuacaccaugaaccucgcuagccugaauuggaacaauuaugauccgacggaagagauucccgccccucuuggcacuccagacuucguagguaagauccaggggguucugacacagaccacuaagggagacggcucuacacgcggccacaaggcuaccguguacacgggguccgcccccuuuaccccuaaauugggaucaguccaguucagcacagauacugaaaacgacuuugagacccaucaaaauacaaaguucacuccagugggugucauccaggauggcgggaccacacaccgaaacgaaccccagcaaugggugcucccgaguuacucuggaagaaauguuccuaacgugcaccuggcaccagccguagcucccaccuuuccuggcgagcaguuacuguucuuuagguccacuaugcccgguuguagcggguauccaaauauggaccucgauugcccucuuccccaggaguggguccagcauuucuaccaagaagcggcaccagcccagucggacguggcucuguugcgguuuguuaacccggauacgggccgugugcuauucgaguguaaacugcacaagucuggauaugucacaguggcccauaccggccagcacgaccucguaauuccucccaacggguacuuucgcuucgauuccugggugaaucaguucuauacucuggcaccaaugggaaacgguaccggcagaaggcgggcccuuuga

SEQ ID NO: 19093 - RNA, 1623 nt, Artificial Sequence
  derived and/or modified sequence opt3 from capsid__Norovirus__ACY00612
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucauggggaagauccagggaguacugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggggaaccacacaccgaaacgaaccccagcaauggguccucccgaguuacucuggcagaaaugugccuaacguucaccuggcaccagccguggcucccaccuuuccuggugagcaguuacuguucuuuagguccacuaugcccggguguagcggcuauccaaauauggaucucgacugccuucugccucaggaguggguacagcauuucuaccaagaagcggcacccgcccagucggaugucgcuuugcuacgguuugugaacccagacacgggacguguucuguucgaguguaaacuccacaagucuggcuaugugacagucgcccauaccgggcagcacgaucuggugauuccgccuaacggauacuuucgcuucgacuccuggguaaaucaguucuauacucuugcacccauggguaacggcaccgggagaaggcgggcccuguga

SEQ ID NO: 19094 - RNA, 1632 nt, Artificial Sequence
  derived and/or modified sequence opt3 from capsid__Norovirus__ACY00615
augaugauggccagcaaggacgcucccaccaacauggauggcacauccggggcaggacagcuggugccugaggccaauacugcggaaccacucccgaucaaacccgucgcuggugccgcaacggccguugcuaccgcaggccaagugaacaugauugacccuuggauaaugaauaacuucguacaggccccacagggggaguuuacaaucucucccaauaacacuccuggagauauucuuuucgaccugcaguugggcccacacuuaaaucccuuucuggcucaucuaucaagaauguacaacgguuggguggggaauaugcaagucaggaucaugcucgccggaaacgcguucagugcaggcaagauuaucgugugcuguauaccuccaggcuuuagcucccagucuaucucgauugcccaggcuaccauguucccgcacguuaucgccgaugugcggguccuggaacccauugacgugccucuugaugacguacgcaauguucuguuucauaacaaugauaacccacagacaaugcgauugcucugcaugcuguauacuccccugcguucagggggaaccagcagugguacagacccuuucgugaucgcaggcagaguccucaccuguccaacgcccgauuuuuccuucuuauuucuggugccgccugacauagagcaaaggacuaaacccuucucugugccaaauauuccuaugaaccuuaugagcaacucccgggucucaauguugaucgaugggaugaugguuaguaaugaccagaaccaggugccccaguuucaaaauggacgcguaacccuggacggccagcuacaggauacaacuaccgugagcgcugccugcgucgcgagaaugaggggucggauuuucaacaauaacgggaauuacggagugaaccucacagaacuggacggcaauccauaucacgccuucgauucucccgcaccucuuggcuuuccagacuucgggaacugugaucugcauaugaccuuuguuaagaucaauccgaacgaguuguccucaggagaccccagcgguaaaguggucauccacaguuacgaugcuacguucgccccucaccucggcacugugaagcuggagaaugacgaugaauuagcucgcuuuguagggaaggagguugugcuggaacucacaugggucucuaaccgagagggagccacccuuaaucugugggcagugccaaacuauggcuccagcuugacucaagccucgcagcuagcucccccuauuuacccacccgguuucggggaggcgauagucuauuuuacaucuaccuucccgacgguguccaacccuaaaguuccaugcacccugccccaggaauuugugucacauuucguaaaugagcaggcaccuacaagaggcgacgccgcucuccugcacuacgucgaucccgacacucauaggaaccuuggagaauuuaagauguacccagagggcuauaugaccugugugccuaaugccgggggagguccccaaacacugccaaucaacggcguuuucguguuuauuaguugggucagccgguacuaucaguugaaaccgguggggacugcaggagccgcucgucgccucggccugagaagguccuga

SEQ ID NO: 19095 - RNA, 1623 nt, Artificial Sequence
  derived and/or modified sequence opt3 from capsid__Norovirus__ACY00618
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugguagaucccuggauuuucaacaauuuugugcaggccccucagggggaguucaccauaagcccaaacaauacacccggagacauccucuuugaucuucaacugggcccucacuugaacccauucuuagcucaucugucccagauguacaaugguugggucgggaacaugagagugaggauucuacucgccggaaaugcguuuacugcaggcaaaaucauuaucugcuguguucccccuggcuucgacgcccggauacugaccaucgcucaggccacacuuuuuccacaccugauugcagaugugcgcaccuuggaaccggucgagcucccccuggaagacgugcgaaacguacuguaucauaauucuucgcagccucaaccaacuaugcgucucguugcuauguuauacacaccccugagaaccgggggagguucaggcgggacggaugccuucguggucgcgggaagggugcuuacuugcccugccccagacuuuagcuucuuguuucuggugcccccgagugucgagcagaagacccggguuuucuccgugccuaacaucccccuaaaagaucucucuaauagccgcguaccagugccuauucagggcauguuuaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcacacccuucauuccucuggaaagcccagcuccggugggguuucccgacuuaggagguugugauuggcacguaaauuucaccuuucagacgcaagaccgcgauccuagucagucuguuacuuucgccacaaacgacgcuuccuuugugccauaucugggcagcgucucgccccauaauggggagggauuccaggccggcgauaucauugguucucucggguggaucuccgcaccuucagacaacagucaguuuaaugugugggccaucccaaaguacggcagcucccuucccgaugucacccaccuggcuccggcgguguucccuccaggauuuggcgaaguuauuuuguauuucuacucuacuuuucccgggagcggacaaccuucacagcuacaggugcccugccugcucccacaggaguucauaacacacuuuuguaacgagcaagcaccuaucgccggugaagcugcccugcuucauuauguagaccccgauaccggccgaaaucugggggaguucaaguuguacccagacggauucaugacgugcgucccgaacaguguguccagcggcccucagacccuccccauuaaugguguuuuuguguucgucucuugggugucaagauuuuaccagcugaaaccaguagggacagcaagugccgcuaggcgguuaggccugcgucgcaucuga

SEQ ID NO: 19096 - RNA, 1623 nt, Artificial Sequence
  derived and/or modified sequence opt3 from capsid__Norovirus__ACY00621
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccuauccagggcauguuuaugucccccgacgugaaccagucaguccaauuccagaaugguagaugucagauagaugggcaacugcagggaacaacuccagugagucuuagccagcugugcaagauuaggggcaaaaccucuuccaacgcacggguuuugaaccucucagagguggacggcacacccuucaucccucuggaaagcccagcuccggucggguuucccgacuuaggagguugugauuggcacgugaauuucaccuuucagacgcaagaccgcgauccuagucagucuguaacuuucgccacaaacgacgcuuccuuuguuccauaucugggcagcgugucgccccauaauggggagggauuccaggccggcgauauuaucgguucucucggguggaucuccgcaccuucagacaacagucaguuuaaugucugggccauuccaaaguacggcagcucccuucccgaugugacccaccuggcuccggcggucuucccuccaggauuuggcgaagugauauuguauuucuacucuacuuuucccgggagcggacaaccuucacagcuacagguucccugccugcucccacaggaguucaucacacacuuuuguaacgagcaagcaccuauugccggugaagcugcccugcuucauuauguggaccccgauaccggccgaaaucugggggaguucaaguuguacccagacggauucaugacgugcguaccgaacagugucuccagcggcccucagacccuccccaucaaugguguguuuguuuucgugucuugggucucaagauuuuaccagcugaaaccaguggggacagcaagugccgcuaggcgguuaggccugcgucgcauauga

SEQ ID NO: 19097 - RNA, 1611 nt, Artificial Sequence
  derived and/or modified sequence opt3 from capsid__Norovirus__ACY00623
augaagauggccagcaacgacgcuacccccuccgaugacggcgcagccgggcuggugccuggaaucaauucugaggucauggcgcucgaaccaguugcuggugccucaauugcagccccggugguaggccagcaaaacauaaucgaucccuggauuagaaauaacuucgugcaggcuccugcaggggaguuuacagucaguccaaggaauagccccggagaacuucuguuggacuuagagcugggcccugaacuaaacccauaccucgcccaccuggcucggauguauaauggucaugccgggggaauggaggugcagaucguucuugcgggcaacgcauucacugccggcgagauucuguuugcugccauacccccuuccuucccauacgaaaauuugucuccggcacagcucacgaugugcccccacgugaucgucgaugugcgccaacuggagccuguacugcucccaaugcccgacauccgaaacguguuuuaucauuacaaucagaacaauucgccuaaauuacgucugguugcuaugcuuuauaccccauugagagccaacaauucaggggaugacgucuucacagugagcuguagggugcugacucggcccaguccggauuuucaguucaccuuucuagucccucccacaguugaauccaagaccaaaaacuucacucucccagugcugcgcguaucugagaugacaaacagcagauuuccugugguccuugaccagauguacaccuccaggaaugagaacauuaucgugcaaccccagaauggacggugcacgacugauggugaacuguugggcaccacaauucuccagucaguuaguaucuguaacuucaaggggacuaugcaggcgaaacugaaugaggaaccacgcuaucaauuacagcugaccaaccucgacggaagccccauagauccuacagacgacaugccagccccgcuuggcacccccgauuuucaggcaaugcuguacgguguggcuucucaacgauccucaacggacaaugccacuagagcucacgaugcccagauugacacagcaggggauaccuucgccccuaagaucggacaggucagguucaagagcaguucuaacgacuuugauuugcaugacccaacuaaauucacacccauuggcgugaauguagaugaccagcacccuuuucggcaauggucccuaccaaacuacggcgggcaccuggcucucaauaaccaucuggcgcccgcaguuaccccgcuuuucccuggagagcagauccuguuuuuccguagcuauaucccaucggccgguggccacacggauggggcuauggacugcuugcucccccaggaauggguggagcauuuuuaccaggaggccgcaccuucucaauccgacauugcccugguccgcuucauaaaucccgauaccggaagaguguuauuugaagcuaagcugcacaaacagggcuuccuaacaaucgccgcaucaggugaccacccaauugucaugccuacuaacggguauuuuagguucgaggcgugggugaaucccuuuuacacccucgcuccaguuggcacaggaaguggccggcgacgcauccaguga

SEQ ID NO: 19098 - RNA, 1647 nt, Artificial Sequence
  derived and/or modified sequence opt3 from capsid__Norovirus__ACY00629
augaagauggccagcaucgacgcugcacccuccaacgauggcgccgcggggcuggugccugagauuaauaacgaagcuauggcccucgacccagucgcaggagccgcuauagcagccccgcuuaccggucagcaaaauaucauugaucccuggaucaugaacaauuucguucaggcuccuggcggggaguuuacagugucuccaagaaacucacccggagaaguacuguugaauuuagagcugggcccugaaauuaacccauaccuagcccaccucgcgaggauguauaaugguuucgcagggggauuugaggugcaggucgugcuggccggcaacgcuuucacugccggcaaaaucauauuugcagcuauucccccuaauuucccaaucgacaaccuuagugccgcgcagaucacgaugugcccgcauguuauuguggauguccggcaacuggagcccgugaauuugccuaugccagacguacgcaacaacuuuuuccacuacaaucaggggagcgauuccaagcuccgacugguugccaugcuguauacaccccuccgugcaaacaauucuggagacgauguguuuaccgucucguguagaguguuaacuaggccuucaccagacuucagcuuuaacuuccuggugcccccgaccgucgaaaguaaaacaaagccuuuuacccuucccaucuugacuauauccgagaugucuaauagccgguucccaguuccuauugauucccugcauacaucacccaccgaaaacaucgugguacagugccagaauggucgcgugacgcuagacggcgagcucauggggacuacccaacugcuuccaagucagauuugugcuuucagaggaguccugacaaggagcacuucucgggccuccgaucaggcugacaccgccacaccccgcuuguuuaacuacuauuggcacauccagcucgacaaucugaacggcaccccuuacgauccagcagaggacaucccgggucccuuagggacgccugauuuccgaggaaaaguguuuggcguugccucacaaagaaauccagacagcacuacaagggcucaugaagcgaagguggauaccacugcaggccgguucacacccaagcuggggagucucgagauuucuaccgaauccgacgauuuugaccagaaccagccuacgcguuucaccccagucggaauagguguggaucacgaggccgacuuucaacaguggagccuucccgauuauucgggccaguucacacacaauaugaaccuggcuccggccguagcaccuaauuuuccaggggaacaguugcuauucuuucgcucucaacugcccuccucaggaggcagaaguaacgguauccucgacugccugguuccucaggagugggugcagcauuucuaccaggagagcgcccccgcucaaacucaggucgcccuugugagguacgucaauccagacaccgggcgggugcuguuugaagcaaaauugcacaagcucggcuucaugacaauugcgaaaaacggagauuccccuaucacuguucccccaaacggcuauuuccgauuugagucuugggugaauccguucuacacccugguaccuauggggacaggaaacggucgcagaaggauacaguga

SEQ ID NO: 19099 - RNA, 1614 nt, Artificial Sequence
  derived and/or modified sequence opt3 from capsid__Norovirus__ACY00632
auggccagcaacgacgcugcacccuccaaugauggcgccaccgggcuggugccugagaucaacacagaaacucucccacuugagccggucgcgggagcugccauugcagcccccguuacgggucagaauaacauaaucgacccuuggauuagaaauaacuucgugcaagcuccaaauggcgaauuuaccguaucucccaggaacucaccuggggagauccugaugaauuuggaauuaggaccagaucugaaccccuaccuagcacaccucagucggauguauaauggcuacgccggugggguggagguccaggugcugcuugcuggaaacgccuucacagcgggcaagauucuguuugcagccguuccuccaaauuucccgguggacauguugagccccgcucagaucacuaugcucccucaucugauagucgaugugcgcacccuggagccaaucaugauuccccucccugacguacgaaacguguuuuaucacuucaauaaccagccagcaccccguaugagauuaguugccaugcuguacacaccgcuuagguccaacggcucuggggaugacgucuuuaccgugucgugccggguguugacucgcccuacacccgauuucgaauuuaccuaucuggucccaccuucaguugagagcaaaacgaagcccuucacucuaccaauccucaccauuggagaacugacaaauaguagauuucccgcuccuaucgaccaacuuuacacuuccccaaacgccgauauagugguacagccgcagaaugguagguguacccuggacggcgaguugcaggggacaacccaacuccugacgacugcgauuugcucuuaucggggaaugacaagcaaccccaccuccgauuacugggacgaccauuuacugcaccucgugcauccuaauggcgccacuuacgauccaacagaggacguccccgcaccuuucgguacccaggauuuucgcgggauccuuuauggaaugcugacgcagaacccacgaaccucaggcgacgaagcugccaauagucacggcauuuacaucagcucuacauccgagaaauucacucccaaguuggggaccaucggacuacaccaggugcaagguagacauucacagcaccagcaaagcaaauucacaccgguuggcauugcugugaacgggaauacuccuuuuaggcagugggaacugccaaacuauaguggagcccucacccugaauacaaaccuugcacccgccgucggcccuaauuuccccggugagcagauacuguuuuuccggucuaacgugccauccguacaagggggccagccuaucgaaauugauuguuugaucccccaggaguggguuagccauuuuuaccaggagucggcuccaucucaguccgacguggcgcucguccguuaugugaauccggauaccggacgcacuauauucgaagcaaagcugcacagacaaggcuuuauuacgaucgccgcuacagggucaaacccugucgugguucccccaaacggauacuucagguuugacaguugggugaaucaguucuaugccuuagcacccauggguaccggcaacgggcggcgacgcguacaguga

SEQ ID NO: 19100 - RNA, 1617 nt, Artificial Sequence
  derived and/or modified sequence opt3 from capsid__Norovirus__ACY00635
augaagauggccagcaacgacgcugcacccuccaaugauggcgccgcggggcuggugccugagaucaacaaugaagucauggcucucgagccaguugccggaggugcaauugccgcuccgcuuaccggccagacaaacgugauagaccccuggaucagaacuaauuucguacaagcaccuaacggggaauuuacgauuucuccaaggaacucacccggagaggugcuguugaauauggaauuaggcccugagcugaauccauuccuaggucaccucagucggauguacaacggguaugccggaggcaucgagguccaggugcugauggcuggcaaugccuuuaccgcggggaaaguuauuuucgcagccgugcccccucauuuuccagucgaaaaccuuagcccgccccaggugacaauguucccucacguaaucguugaugugcgcacucuggagccaauauugcucccccugccugacguccgaaaucaguuuuuccauuacucccaaguggaugaaccaaagaugcgucugguggcuaugcucuauacccccuuaagaucuaacggaucggccgaggacgucuuuacaguuucaugcagggugcugacccggccgagcccugauuucgaguuuaauuaccuuguacccccaacuguggaaagucgcacaaaaccuuucaccguccccaucuugacgauuggugagauguccaacucuagauuuccagcacccaucgacgugauuuauacuagcccuaacgauaaucagaacguucagccacagaaugggagguguacccuggacggggaacuacaaggaacaacucagcucgugccguccggcgucugcgcuuuccggggucgcaucaccucacacgaggggagugaacagaaccaguggcauaugcaacugacaaaucuuaacggaacccccuucgauccuacggaggacauaccagcgccccugggcacuccugauuuuaagggcgagauuuucggguuuaucagccagcgaaaugcccagaacgacccaggacaaucucagcccgccaauagagcacacgacgcugugguauccacaagggccccgaaauucaccccuaaguuggguucaguuaugauuggcacuugggugaacagcgauaucgaaaaucagccaaguaaguuuacacccgucgggcucaacucuuccgagaauuucaaacagugggaacugccugacuacagcggaguguuaacccugaacaugggccucgcucccgucgugcacccaacguauccuggugagcaaauccuguuuuuccggucguacauuccccuuaagggcggccauggaaauccagccauagauuguuugcuaccgcaggaauggauccagcacuuuuaccaggagucugcaccuucccaaaccgacguugcccugcucaaccccgauacaggccgugugcuguucgaggcuaaacuucaucgccagggguauauuacuaucgcgaagucaggagacgguccaauaguagugcccccuaacggcuacuuuagauucgauaguugggucaaucaguuuuauagccuggcaccaauggggaacggaaauggcaggcggcgaguucaguga

SEQ ID NO: 19101 - RNA, 1632 nt, Artificial Sequence
  derived and/or modified sequence opt3 from capsid__Norovirus__ACY00638
augaugauggccagcaaggacgcucccaccaacauggauggcacauccggggcaggacagcuggugccugaggucucuacugccgaaccaaucucaauggagccgguugcgggugcugccacggcagccgcuaccgcaggccaagugaauaugauugaccccuggauaaugaguaacuacguacaggccccucagggggaguucacaaucagcccaaauaacacucccggagauauucucuuugaccuucagcugggcccucacuugaauccauucuuaucccaucuggcucaaauguauaacgguuggguggggaauaugaaagucagagugcuacucgccggaaacgcguuuaccgcaggcaagaucauuaucucuugcguucccccuggcuucgccgcucagaaugugucgauagcccaggcaacaauguuuccacacgucaucgcugaugugaggguacuggaaccgauugaaguuccccuugaggacgugcggaacguccuguuccauaauaacgauucaaccccuacuaugcgcuugaucuguaugcucuacacaccacugcgagccagcgggaguuccucuggaaccgaccccuuugugauugcgggucgugugcugacgugcccuagcccagauuucaauuuucucuucuuaguucccccgaacguugagcagaaaacuaagccuuuuuccgugcccgaccugccacuuaauguauugucaaacaguagagugccuagccugaucaaaucuaugauggucucccaagaucacggccagauggugcaguuccagaacgggaggguuacccuagacggacaacuccagggcacaacucccaccucagccagccagcuguguaagauacgggguacaguguaucaugcaaccgggggacaaggccuuaaucugacggaaauugauggcacuccauaccacgcuuuugagagucccgccccuaucggguucccagacuugggagaaugcgacuggcacauuaacgcuucuccggccaaugcauucacagaugguuccaucauccaucgcauugacgucgugcaggaucccaccuuugccccucaccucggcacuauacauuauacaaacgcuaauuacgacgcgaacguaagccugaucuguucguuagaguggcugucuccacccuccgggggagcacucaaggccaauccuugggcuauuccaagauauggcucaacccuuacggaggccgcacagcuggcucccccgaucuacccuccagguuucggggaagccauagucuuuuucaugagugauuuucccauugccaacggcagcgacggauuguccgugccuugcaccaucccccaggaguucgucacacacuuugugaaugaacaagcaccaacuaggggcgaggcggcucuacugcacuacgucgauccugacacccaucggaaccucggggaguucaaacuguaucccgaaggauuuaugacaugugugccaaauucuagcgguucaggcccgcagacucuuccuaucaacgggguuuucaccuuuauuaguugggugucccgcuucuaccagcugaagcccguaggaacaaccggcccaguccgaagauuggguaucaggcggagcuga

SEQ ID NO: 19102 - RNA, 1635 nt, Artificial Sequence
  derived and/or modified sequence opt3 from capsid__Norovirus__ACY00641
augaugauggccagcaaggacgcucccaccaacauggauggcacauccggggcaggacagcuggugccugaggccaauacugcggaaccaaucucuauggacccggucgcuggugccgcaacggccguugcuaccgcaggccaaauuaacaugauagaucccuggaucaugucaaauuucgugcaggccccucagggggaguuuacaguaaguccaaacaauacucccggagacgugcuguucgaucuucagcugggcccucaauugaacccauuuuuagcucaccuggcccagauguacaaugguugggucgggaacaugagagugaaaguucuacucgcgggaaaugcauucaccgccggcaagauuaucauuagcugcauacccccuggcuuuacaucccagaacaucucuaucgcucagaugaccauguucccacaugugauugccgacgucagggugcuggaaccgaucgagauuccccuugaagauguacggaauguucuguuucacacuaacgacaaucgcccuacaaugcgauugguguguaugcucuauaccccacugcgugcaaacgggucgucaagcggaacggaucccuucgucaucgcugguagagugcugacuugcccugacaguaauuuuuccuuccucuuuuuagugccacccaacgucgagcagaaaaccaggccguucucuguuccuaacauaccccugaauacacuuagcaacucccgggugccaucauugauuaagaguaugacuaucagccgcgaucaaaaucagauuauccaguuucaaaacggcagaguaacccuggacgggcagcuacagggaacaaccccuacgucugugucccaacucuguaaaaucaggggcacuacauaccaugccaccggugggucaggaauuaaucugacugagcuuaacggcgaacccuaucacgcguucgagagcccagcccccauaggcuucccugaucucgggggaugcgacuggcauuugacagcaaccccaacgcaggcuuuuaaugacggugccaaggucgugcggcucaguguuacccagggcgcugccuucgcaccgcaccuggggacaauccacuacacuaccacagauacugacuauaaccccaauaccucuauuaucuguacauuagauuggcugucccagaccacuggacaaagcaacguggacccuuggcagauaccaacguacggcucgacacucaccgaagccgcucagcuugcgcccccuauuuuuccacccgguuucggggagacucuggucuuuuucuugucugauuuuccgaucuccaauggcaagaacggacuaucagugccuugcacccugccacaggaguucguaacacauuuuguuaaugaacaagcacccauccgcggcgaggccgcucuccugcacuaugccgacccugauacccaucgaaaccuuggggaguucaaacuguaccccgaaggauuuaugacuugugugccaaauacaagugguggcgggccucagacguugcccauuaacggagucuucguguuugucagcuggguguccagauucuaccagcucaagccaguuggcaccgccggugcagcuaggcggcuggggauccgucgcucuuga

SEQ ID NO: 19103 - RNA, 1635 nt, Artificial Sequence
  derived and/or modified sequence opt3 from capsid__Norovirus__ACY00645
augaugauggccagcaaggacgcucccaccaacauggauggcacauccggggcaggacagcuggugccugaggccaauacugcggaaccaaucucuauggacccggucgcuggugccgcaacggccguugcuaccgcaggccaaauuaacaugauagaucccuggaucaugucaaauuucgugcaggccccucagggggaguuuacaguaaguccaaacaauacucccggagacgugcuguucgaucuucagcugggcccucaauugaacccauuuuuagcucaccuggcccagauguacaaugguugggucgggaacaugagagugaaaguucuacucgcgggaaaugcauucaccgccggcaagauuaucauuagcugcauacccccuggcuuuacaucccagaacaucucuaucgcucagaugaccauguucccacaugugauugccgacgucagggugcuggaaccgaucgagauuccccuugaagauguacggaauguucuguuucacacuaacgacaaucgcccuacaaugcgauugguguguaugcucuauaccccacugcgugcaaacgggucgucaagcggaacggaucccuucgucaucgcugguagagugcugacuugcccugacaguaauuuuuccuuccucuuuuuagugccacccaacgucgagcagaaaaccaggccguucucuguuccuaacauaccccugaauacacuuagcaacucccgggugccaucauugauuaagaguaugacuaucagccgcgaucaaaaucagauuauccaguuucaaaacggcagaguaacccuggacgggcagcuacagggaacaaccccuacgucugugucccaacucuguaaaaucaggggcacuacauaccaugccaccggugggucaggaauuaaucugacugagcuuaacggcgaacccuaucacgcguucgagagcccagcccccauaggcuucccugaucucgggggaugcgacuggcauuugacagcaaccccaacgcaggcuuuuaaugacggugccaaggucgugcggcucaguguuacccagggcgcugccuucgcaccgcaccuggggacaauccacuacacuaccacagauacugacuauaaccccaauaccucuauuaucuguacauuagauuggcugucccagaccacuggacaaagcaacguggacccuuggcagauaccaacguacggcucggcccucacagaagcugcgcagcuugcacccccuauuuuuccacccgguuucggggagacccuggucuuuuucuugucugauuuuccgaucuccaauggcaagaacggacuaucagugccuugcacucugccacaggaguucguaacccauuuuguuaaugaacaagcccccauccgcggcgaggcugcccuccugcacuauguggacccugauacacaucgaaaccuuggggaguucaaacuguaccccgaaggauuuaugaccugugucccaaauacaagugguggcgggccucagacuuugcccauuaacggaguguucgucuuugugagcuggguuuccagauucuaccagcucaagccagugggcacggccggugcagcuaggcggcuggggauccgucgcucuuga

SEQ ID NO: 19104 - RNA, 1635 nt, Artificial Sequence
  derived and/or modified sequence opt3 from capsid__Norovirus__ACY00647
augaugauggccagcaaggacgcucccaccaacauggauggaacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauauucucuuugaccuucagcugggcccucacuugaauccauucuuaagucaucuggcccaaauguauaacgguuggguagggaauaugaaagugaagguccuacucgcgggaaacgcauuuaccgccggcaaaaucauuaucagcugcauacccccuggcuucgcugcccagaauaucuccauugcacaggcuacaauguuuccacacgugaucgccgauguuagagugcuggaaccgauugaagucccccuugaggacgugaggaacguacuguuccauaauaacgauaauucuccuaccaugcgguugguuuguaugcucuacacuccacugcgcgcgucggggucaagcaguggaacagaccccuuugugaucgccggucgaguccugaccugcccuuccccagauuucucuuuucucuucuuagugcccccgaacguggagcagaagacgaaaccuuuuagcguccccaaccugccacuuaauacuuuguccaacucacguguuccuagucugauaaaugcaaugaugauuagcagagaccacggccaaauggugcaguuccagaacgggaggguaacccuagauggacagcuccaaggcacaacucccaccucucugucccagcuuuguaagauccgggguaagguguuucaugcuucagggggaaauggccugaacuugacagaacucgacggcagcgccuaucacgcuuucgagaguccagcccccauuggguucccugauaucggagaaugcgacuggcacaugaaugcaaccgccacgucuaacuuuacugguuccaaugacgaguaccagauccuggucaaacaagagagcacauucgcuccacauuuaggccacgugcaggcggauucgcugucugcagacgccaacaccgaucucaugguuucccuuucauggauuaguccggugagcgaccagcaucgcagagaugucgaccccugggugauaccuagguauggguccucucugacugaagcugcccaguuggcaccacccaucuacccuccaggauuuggcgaggccauuguauucuuuaugagcgauuuccccguugugucaggugucaaugggaugcggaucccguguacacuaccucaagaauauguggcucacuuugucaacgagcaggccccaacccgcggcgaagcagcgcugcuccacuacguggaccccgauacgcaucgaaaucugggagaguucaagauguacccugagggcuuuaugaccugcguucccaacaguuccgggagcggaccacagacacuuccuauaaauggugugcugacuuucguaucuugggucucaagauuuuaucaguugaaacccgugggcaccgcugggccagccaggcggcucggcauucgucgcaguuga

SEQ ID NO: 19105 - RNA, 1668 nt, Artificial Sequence
  derived and/or modified sequence opt3 from capsid__Norovirus__ACY00650
augagaauggccagcuccgacgcucccgugucuggcaccgauggggcagccggacuggucccugagucacagcaagaaguucucccacuugagccgguggcggguguacagcuggcugcccccguggcaggccagaguaacaucauugacccuuggauaaggaugaauuucguccaggccccagcuggggaauuuacagugagcccccgggaugcaccuggagagguuuugaucgacuuagaacugggcccagagcuaaaccccuaccucaaucaccuggcccgcauguauaacgguuacgucgggggaauggagguggaagugguacuugcuggcaaugccuucacugcgggcaagauucuguuugcagccguuccuccauccuucccgacgcaugggaucucugcugcccaagcaaccauguugccccacgugauugucgaugugcgacagcucgagccugugcgucugccacugcccgacgucagaaacguuauguuucauuucugccaggaaaauaaagagccuaggaugcggaucguggcuauacucuauacaccauuacgcgccaacggagcgggugaugacguauuuacugugucguguagaguccugaccaggcccucaccggauuucgacuuuaucuuccuuguguugccuagcguugagaguaagcugaaacaguuuacacuacccaaucuccaaccaaacgaaaugaccaauucccgguucccuacuggcauuauccagcuguacacaucucccaacaccaaucuugugguccaguuucagaacgggcgcugccuguuggauggaacgcuccugggcacuaccccagugcgagccgcagacauuuguagcuucagagguguaacauccacugagguugaugcuaccgacucacccaggguggccgggagucaccggaucaugguccaauuaaaggaaccugacggagaggaguucagcccaacaggcccgaaucccgcuccugugggcaccccagauuuucaggccgcaauauucgggacgcugucucagcguaacacuggaggugccggccaaaacuccaaucgcgcuagauuugcguauuucuacacaaggaaccccaccuuugcaccugggauuggaacugucguguucucauuugacacaaccgauuuccagaaucggcagccaacgaaauuuagccccaguggcguuuucgacgaugacucuuccgaaccguuuaaccaguucagccucccuuauuacaaugguucgcuuggggccguggaugcuggcaagcuggccccacccguagcaccuaacuaccccggagagcaaaucuuguauuuucgaggcaauauuccauucaaagggggauacggugaaggcgagaucgacucucuacugccucaggaauggaucacccauuucuaugccgagcaggcucccacacagggggaugccgcacuccugcgcuacuauaacccagacacuggaagaguccuuuuugaaugcaagcugcacagggagggcuucauuaccauaaauuacacagguuccaacgcguuggcugugccgguuaaugggguguuucgguucgagggcugggucaacaaguuuuauacucucaccccuaugggaaauggcaacgggcgcagaggaaggcgucgggaacuguga

SEQ ID NO: 19106 - RNA, 1617 nt, Artificial Sequence
  derived and/or modified sequence opt3 from capsid__Norovirus__ACY00656
auggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggagaucuuguuaaaucuggaacuaggaccugagcucaacccauaccuggcccaccuuagccggauguauaauggcuacgcugguggggucgaggugcagguucuguuggccggaaacgcguucacggcaggcaagcucguguuugccgcuauucccccucauuucccagucgauaaucuguccccgggccagaucaccauguuuccccacgugauuaucgacguacgcacacuggaaccuguucucuuaccacugcccgaugugcgaaacaauuucuuucauuauaaccagcaaucugaccagcguaugagacuugucgccauguuguacacuccucugaggucgaacgggucaggagaugacguguucaccgugagcugccggguccuaacacgcccaagucccgauuuugacuucaauuaucucguuccgccuaccguggaguccaaaacuaagcccuuuucuguaccagugcugacacuuaacgaacugaccaauagcagauucccuguccccauagaugcaauguacacguccccaaacgacucaaucgugguucagccccagaaugguagggcuacuauugauggcgaguugcucgggaccacacaacugaucccuaguggaauuuguagcuuucggggcaaaaucacuacccacuuagccgacgaccgccaucuguggaacauacaggugucuaaucucaacgguacaccauucgauccgaccgacgauguccccgcgccucuugggaugccagacuucuccggacagauuuuuggcgugguaucacagcgagauacgggcacuaaucccgccaacagagcacacgacgcuguucuggccacauauagcgcuaaguacaccccuaaauuggggagugugcaaaucggaacuugggauacagaggaccuacuggaaaggcagccagucaaguucacccccgugggucucaaugagauuggccaggauaagcacuuugaccaauggguccugccgaacuacucuggggcccuuggacugaauaugcauuuggccccugcaguguccccacucuuccccggcgaacggcuguuauuuuuccguagcuauaucccucugaaaggugggcacggcgaucccuuuaucgacugccuaguuccacaggaguggauucagcauuucuaccaggaaucggcuccugcgcaaucuuccguggcacuccugcgcuauguaaaccccgacacgggaagaacccuuuuugaggccaaguugcacaaaggcggguucauaacagucucaaguacugagaauaggccagugaucguuccgccuaacggauacuuucgguucgauagcugggugaaccaguuuuauucccuggcucccauggguaccggcaaugggcgacgcagaaugcaguga

SEQ ID NO: 19107 - RNA, 1623 nt, Artificial Sequence
  derived and/or modified sequence opt3 from capsid__Norovirus__ADK47170
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccugucucggauguauaauggcuacgcugguggguucgaagugcaggucauucuagccggaaacgcguuuacugcaggcaaaaucauuuucgccgcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaauucccgcuuuccaaucccccuggagaaacuuuucacgggaccuucaagugccuucguugugcagccacagaacgguagauguacuaccgauggcgucuugcuggggacaacucaacuaagcccggugaauauaugcaccuuuaggggagacguaacacauauucccggcucucggaacuacaccaugaaucucgcgucccagaacuggaacucauaugauccuacggccgagaucccagcaccccuggguacuccugacuucguugggaagauucagggagugcuuacacagaccacucgcacaaauggcagcacccgaggccacaaggcuacggucuacaccgggagugccgacuuuucuccaaagcugggaagagugcaauucgcuacagauacugacaaugauuuugaaaccaaccagaauacaaaauucacucccgucggugugauccaggacggcuccaccacaccgaggaacgagccucaacaguggguuuugccaagcuacucggggcggaauauccauaacgugcaccucgcccccgcaguagccccuaccuuucccggagaacagcuguuauucuuucguucuacuaugccaggcuguuccgguuauccuaauauggaucuggacugccuccuuccccaggaguggguccaauacuucuaucaggaagcugcgccagcacagucagauguggcccuguugcgcuuuguuaacccggacacggggagagugcuauucgaguguaagcugcacaaaaguggcuacgucacaguggcucauaccggacagcacgaucucguaauuccucccaacggcuauuuuagguucgacagcugggugaaucaauucuacacucuggccccaauggggaacggaaccggucggcgacgcgcacuuuga

SEQ ID NO: 19108 - RNA, 1644 nt, Artificial Sequence
  derived and/or modified sequence opt3 from capsid__Norovirus__ADR30514
augaagauggccagcaacgacgcugcacccuccaaugauggcgccgcggaccuggugccugaggcuaacaaugaagucauggcccucgagccaguugugggggcaucuaucgccgcuccgguagugggacagcaaaacauuauagaucccuggaucagagaaaauuucguccaggcaccucagggugaguuuaccgugucaccaaggaacagucccggcgaaaugcuucugaauuuggaguuagggccugagcugaacccauaccuaagccaccucucccggauguauaauggauacgccggcgguaugcagguucaagugguccuggcugggaacgccuucacagcgggaaaaauuaucuuugcagccgugcccccucauuucccaguagaaaauauuucugcugcccagaucacuaugugcccgcacguuauaguggacguccgccagcuugagcccgugcuguugccucucccagauauccgaaacagauuuuuccauuauaaucaggaaaacacgccccguaugaggcugguggcaaugcuguacaccccucuccgggcuaauucgggcgaggacgucuuuacaguuucaugucgcguguuaacuagaccagcccccgauuucgaguuuaccuuccugguaccgccuacaguggaaagcaagaccaaacccuuuacucuuccaauuuugacacugggcgagcuaaguaacuccagguucccugcgcccaucgacaugcucuauaccgauccaaacgaagggauugucgugcaaccccagaauggacggugcacgcuggacgguacucuucagggcaccacacagcugguuccuacucaaaucugugccuuucgcgggaccuugauaggacagacaucucgaagcuccgauucaaccgacagugcaccaagaaggcgggaucacccgcuccaugugcagcugaagaacuuagacggcacgcaauacgaccccacugaugaggucccugcugugcugggugccauugacuucaaagggacaguauucggaguugcuagccagcgugaugugucuggccagcaggucggcgccacccgcgcacacgaagugcacaucaauacuacagacccaagauauacccccaagcucggguccauucuuaugcauucagagagcgaugacuuugucacgggacaaccugugagguucaccccaaucgguaugggcgauaacgacuggcaccagugggagcugcccgauuacagugggcauuugacacuaaauaugucucuggccccggcuguugcgccugcauuuccaggagaacggauccucuucuuucgauccauugugcccagcgccggcgguuacgggucgggccagauagacugccugaucccucaggaguggguacaacacuucuaucaggaagcugcccccucucaguccgcagucgcccuuauucgcuacgugaacccagauacuggaagaaauaucuuugaggcuaagcugcacagggaaggcuucauaaccguugccaacucagggaauaacccuauuguggugcccccaaauggauauuuucgguucgaggcaugggucaaccaguuuuacacauugacuccgauggguaccggccaagggcgcagaaggaaucaguga

SEQ ID NO: 19109 - RNA, 1623 nt, Artificial Sequence
  derived and/or modified sequence opt3 from capsid__Norovirus__ADR78255
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcagccggaacuacaccaugaaucucgcaacgcagaacuggaacucuuaugaucccacugaggaaauuccugcuccacuggguacacccgacuucguagggaagauccagggaguucuuacccagacuacacgcgccgacggcuccacccgaggccacaaggcuacgguguacaccgggucagccgauuuuagcccuaagcugggaagaguccaauucgcaacagacacugauaaugacuuugaugccaaucagaacaccaaauucacaccagugggugucauccaggacggcaauacugcucauaggaacgagccccaacaguggguguugccgaguuacucugggcguaauucccacaacguucaccucgcgccugcaguggccccaaccuuucccggagaacagcuguuauucuuucggagcacaaugccuggcuguucggguuaucccaauauggaucuggacugccuccuuccacaggaguggguacaauacuucuaucaggaagcugccccugcacagucugaugucgcccuguugcgcuuugugaaccccgacaccgggagaguucuauucgaguguaagcugcauaaauccggcuacgugacugucgcucacacgggacagcaugaucucgugauuccaccgaacggcuauuuuagguucgacucauggguaaaucaauucuacacacuggccccuauggggaacggaaccggucggcgacgcgcacuuuga

SEQ ID NO: 19110 - RNA, 1623 nt, Artificial Sequence
  derived and/or modified sequence opt3 from capsid__Norovirus__ADR78259
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccugucucggauguauaauggcuacgcugguggguucgaagugcaggucauucuagccggaaacgcguuuacugcaggcaaaaucauuuucgccgcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaauucccgcuuuccaaucccccuggagaaacuuuucacgggaccuucaagugccuucguugugcagccacagaacgguagauguacuaccgauggcgucuugcuggggacaacucaacuaagcccggugaauauaugcaccuuuaggggagacguaacacauauucccggcucucggaacuacaccaugaaucucgcgucccagaacuggaacucauaugauccuacggaggaaaucccagcaccccuggguacuccugacuucguugggaagauucagggagugcuuacacagaccacucgcacaaauggcagcacccgaggccacaaggccacggucuacaccgggagugcugacuuuucuccaaagcugggaagagugcaauucgccacagauacugacaaugauuuugagaccaaccagaauacaaaauucacucccgucggugugauccaggacggcuccaccacaccgaggaacgaaccucaacaguggguuuugccaagcuacucggggcggaauauccauaacgugcaccucgcucccgccguagcaccuaccuuucccggagagcagcuguuauucuuucguucuacuaugccaggcuguuccgguuauccuaauauggaucuggacugccuccuuccccaggaauggguccaauacuucuaucaggaggccgcuccagcgcagucagauguggcacuguugcgcuuuguuaacccggacacggggagagugcuauucgaguguaagcugcacaaaaguggcuacgucacaguggcccauaccggacagcacgaucucguaauuccucccaacggcuauuuuagguucgacagcugggugaaucaauucuacacucuggcuccaauggggaacggaaccggucggcgacgcgcccuuuga

SEQ ID NO: 19111 - RNA, 1623 nt, Artificial Sequence
  derived and/or modified sequence opt3 from capsid__Norovirus__ADR78262
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccugucucggauguauaauggcuacgcugguggguucgaagugcaggucauucuagccggaaacgcguuuacugcaggcaaaaucauuuucgccgcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaauucccgcuuuccaaucccccuggagaaacuuuucacgggaccuucaagugccuucguugugcagccacagaacgguagauguacuaccgauggcgucuugcuggggacaacucaacuaagcccggugaauauaugcaccuuuaggggagacguaacacauauucccggcucucggaacuacaccaugaaucucgcgucccagaacuggaacucauaugauccuacggaggaaaucccagcaccccuggguacuccugacuucguugggaagauucagggagugcuuacacagaccacucgcacaaauggcagcacccgaggccacaaggccacggucuacaccgggagugcugacuuuucuccaaagcugggaagagugcaauucgccacagauacugacaaugauuuugagaccaaccagaauacaaaauucacucccgucggugugauccaggacggcuccaccacaccgaggaacgaaccucaacaguggguuuugccaagcuacucggggcggaauacccauaacgugcaccucgcucccgccguagcaccuacuuuucccggagagcagcuguuauucuuucguucuacgaugccaggcuguuccgguuauccuaauauggaucuggacugccuccuuccccaggaauggguccaauacuucuaucaggaggccgcuccagcgcagucagauguggcacuguugcgcuuuguuaacccggacacagggagagugcuauucgaguguaagcugcacaaaaguggcuacgucaccguggcccauacuggacagcacgaucucguaaucccucccaacggcuauuuuagguucgacagcugggugaaucaauucuacacccuggcuccaauggggaacggaacaggucggcgacgcgcccuuuga

SEQ ID NO: 19112 - RNA, 1623 nt, Artificial Sequence
  derived and/or modified sequence opt3 from capsid__Norovirus__ADR78266
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccugucucggauguauaauggcuacgcugguggguucgaagugcaggucauucuagccggaaacgcguuuacugcaggcaaaaucauuuucgccgcugugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgccaugcucuauacuccccugcgugcaaacaacgcuggggaugacguguucaccgucaguugcagaguucugacaaggccguccccugauuuugacuucauuuuucucgugcccccaaccguagaaucucggacuaaaccuuucagcgugcccgucuuaacaguggaggaaaugaccaauucccgcuuuccaaucccccuggagaaacuuuucacgggaccuucaagugccuucguugugcagccacagaacgguagauguacuaccgauggcgucuugcuggggacaacucaacuaagcccggugaauauaugcaccuuuaggggagacguaacacauauuucuggcucccggaacuacaccaugaaucucgcgucacagaacuggaauagcuaugaucccacggaggaaaucccugccccacuggguacucccgacuucguugggaagauucagggagugcuuacacagaccacucgcacaaacggcaguacccgaggccacaaggcaacggucuacaccgggucugcugacuuuuccccuaagcugggaagagugcaauucgccacagauacugacaaugauuuugagaccaaccagaauacaaaauucacuccagucggugugauccaggacggcagcaccacacccaggaacgaaccgcaacaguggguuuugccuucguacucugggcggaauauccauaacgugcaccucgcuccagccguagcacccaccuuuccuggagagcagcuguuauucuuucguuccacuaugcccggcuguucagguuauccaaauauggaucuggacugccuccuuccucaggaauggguccaauacuucuaucaggaggccgcucccgcgcagagugauguggcacuguugcgcuuuguuaacccagacacggggagagugcuauucgaguguaagcugcacaaaagcggcuacgucacaguggcccauaccggacagcacgaucucguaauuccgccuaacggcuauuuuagguucgacuccugggugaaucaauucuacacucuggcucccauggggaacggaaccggucggcgacgcgcccuuuga

SEQ ID NO: 19113 - RNA, 1623 nt, Artificial Sequence; identical to SEQ ID NO: 19110
  derived and/or modified sequence opt3 from capsid__Norovirus__ADR78268

SEQ ID NO: 19114 - RNA, 1569 nt, Artificial Sequence
  derived and/or modified sequence opt3 from capsid__Norovirus__AFQ00093
augaagaugaccgacagagauaucguggacagcgcccccgcucugggccagguccucccuccagagguugaagcauccgugccgguagagcccacagccggggcgccuguggcugccucuacugcaggaagggucaacccaauugaucccuggauauucgccaauuuugugcaagcuccucagggugaauuuacgaucucaccaaacaauaaccccggcgagauucuuuuugaacuggaguuggggccugacuuaaauccauaccuggcacaccuacggcgcauguauaacggauggaccggcaguaugcgaguucgugugcuccuggccgguaaugcuuucagcgccgggaaagucgugguauuuugcguuccgcccggauucgauacauccuaccuuacuccuucucaggcgacccaguuuccacaugugcugaucgacgucagagcacccgagccuguggauaugccauuggaagacgugaggaacauucucuuccaccaaggccccgauucgcggaugcgccugaugggcaugcuguauacaccgcucagagccaauucaggggcugacccuuuugucguuaccggaaggguguuaacuugucccagcccaaacuucaguuucuucuuucugguaccucccacaguggaggaacgggagccacccuucacccuuccuaauuugccagucaacucccugucucauagccgcgugauggagccgaucgcccagaugauguccucacgaaguuuccccgcaagcguucaguuucagaaugguagaugcacgcuaucuggcgaucuccuggggacuaccccuuccucaccagcugaccuuggagccuucgugggccugauagcggaacccgguagcagggucguggaguugagucaaccuaaccaggaagauuuucacgccgggucugcaccagcucccuucggauuuccggacuucuccgaguguagcguaacauuuguuguggccucggcuacuaccgucggcgaacggacagugaaugcccguaacccucagaacuucaccccagcacucggccauaucacguuugacgaggaggcccccgcugaucuguuccgcgcgagauuuaggaauuuaugggaaccuacugagcacucuuucuggcggauucccgacuaccgagcagauguccugggguccgacuuugccccaucagugagugcuccuggaguuggugaaacacuccuuuucuucaugugcaacgugccccgccugaauggcgccaacccaaauccguguccuugcuugcuaccccaggaguggaucacccacuuuguaagcgaaagagcagcccugcaauccgaugucgcucuccugaacuaugugaauccaaacacugggaggguucuuuucgaggccaagcuguacgcaaauggauuuuugacagugaaccucggcgcgucugaccaggcuauucugcccgucgaugguaucuucaaauuugugagcuggguaucauucuauuaccaguuacggccuguggggaauauaaguguuggccgcagacugccaaggcuagacggauuuuga

SEQ ID NO: 19115 - RNA, 1629 nt, Artificial Sequence
  derived and/or modified sequence opt3 from capsid__Norovirus__BAI52939
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaauuuagaacugggaccugagcuaaacccauaccucgcgcaccuggcacggauguauaauggcuacgccggugggauggaggugcagguuaugcuugcuggaaacgccuucaccgcaggcaaacugguguuugcugccgugcccccucauuucccaaucgaaaauuugaguccgcagcagauuacaauguuuccccacgucaucauugauguacgcacucucgagccuguucugcugccacuccccgacgugcgaaacaauuucuuucauuauaaccaaaaggaugacccuaaaaugcguaucgucgcgauguuauacaccccacugagaagcaauggcuccggggaugacguguucacagugucuugcaggguccuuacccggcccucgccggauuuugacuucacuuauuugguuccucccacaguggaaucaaagaccaaaccauuuacgcugccuauacuaacucucggagagcugagcaacagucgcuuccccgccuccaucgaucagauguacaccucuccaaacgagguaauuagcgugcagugucagaaugguagaugcacacuugacggcgaacugcaagggacuacccaguugcaggucuccggaaucugugcauuuaagggcgaggugacagcucaccuccaugauaacgaccaccuguauaauauuaccaucacgaacuuaaaugguucacccuucgacccuagugaagauauaccagccccgcuggggaugcccgacuuccagggaaggguuuuuggcauuaucagccaacgggaucgccacaacucuccuggccauaaugagccagcuaaccgagggcacgacgccgugguccccacuuacacagcacaguacaccccuaagcucggacagauucaaaucgguacuuggcagacagaugaccuuaccgugucccagccaguaaaauucacgcccguuggccugaaugauaccgaacauuuuaaccaguggguggucccgagauaugccggggcuuugaaucuaaacacaaaucuggcgccuucaguggcaccagucuuccccggagagaggcuccuguuuuuccggagcuacaucccucuuaagggcgguuaugggaaccccgccauugacugccuguugccacaagagugggugcagcacuuuuaccaggaagcugccccuaguaugucugagguugcacucgugcguuguauaaaucccgauacuggccgcgcccuguucgaagcuaaauuacacagagccggauuuaugaccguauccagcaacacaucggcaccagucgugguuccggcgaacggcuauuucagguuugacucuugggugaaucaguucuacucccuggcuccuauggggacuggaaacggucggcgacgcguccaauga

SEQ ID NO: 19116 - RNA, 1623 nt, Artificial Sequence
  derived and/or modified sequence opt3 from capsid__Norovirus__BAI52940
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucgggcccucccagguaacgauguucccucauaucauaguugacgugcgccaacuggagccaguccuuaucccccugccugaugugcgaaauaacuuuuaucacuacaaucagucuaacgacucgaccauuaaguugaucgcuaugcucuauacaccacugcgugccaacaaugcgggagaagauguguucacugucucaugcagaguucugaccaggcccagcccggacuuugauuucauuuuucucgugccucccacaguagagagucggaccaaaccauucacugugccuaucuuaacagucgaagagaugaccaacucccgcuuucccauaccacuggagaaacuuuucacgggucccucuagcgccuucgugguucagccucagaauggcagauguacuaccgacgggguguugcugggaacaacucaacuauccccagucaacauuugcaccuuuaggggcgaugugacacggaucgcagguucacgcaauuacaccaugaaccucgcuagucugaauuggaacaauuaugacccgacggaagagauucccgccccucuugggacuccagauuucguaggaaagauccagggcguucugacacagaccacuaagggcgacgggagcacacgaggacauaaggcuaccguguacacggguucugcccccuuuaccccuaaauugggcuccguccaguucucaacagacacugaaaacgauuuugagacccaccaaaauacaaaguucacuccagugggggucauccaggacggaggcaccacacauagaaacgaaccccagcaaugggugcucccgagcuacagugguaggaauguuccuaacgugcaccuggcaccagccguagcucccaccuuuccuggggagcaguuacuguucuuucggucuacuaugcccggcuguuccggauauccaaauauggaucucgacugccuucugccucaggaguggguccagcacuucuaccaagaagcggcacccgcccagagcgauguggcuuugcuacguuuuguuaacccagacacgggccgcgugcuguucgaguguaaacuccauaagucgggguaugucacaguggcccacaccggacagcaugaucugguaauuccgccuaacgguuacuuuagauucgacucuugggugaaucaguucuauacucuugcacccaugggcaacgggaccggaaggcggcgagcccuguga

SEQ ID NO: 19117 - RNA, 1623 nt, Artificial Sequence
  derived and/or modified sequence opt3 from capsid__Norovirus__BAQ20801
augaagauggccagcuccgacgcuaaccccucugauggcucagcagccaaucuggugccugaggucaacaaugaagacauggcgcucgagccaguugugggggcugccaucgcagccccgguagcuggacagcaaaacgugauugaucccuggauaagaaauaacuucguccaggcaccugguggcgaauuuaccgugaguccaaggaaugcccccggggagauccuuuggagcgcuccucugggaccagacuugaaccccuacuuaucccaccuggcccggauguauaauggcuacgcggguggguucgaaguucaggugauucuagcaggaaacgccuuuacagcuggcaaagucaucuucgccgcagugccuccaaauuuuccgacugagggccucucucccucgcagguaacgauguucccucauauuguuguggauguccgccaacuggagccagugcuuaucccccugccugacgugcgaaacaauuuuuaucacuacaaccagucaaaugauccaaccauaaaguugaucgcuaugcucuauacaccccugcgugccaacaacgcgggggacgaugucuucacuguuagcugcagagugcugaccaggccgaguccugacuuugauuucauuuuucucguacccccaacaguggaaucccggaccaaaccuuucucuguccccguguuaacuguugaggaaaugacaaauagccgcuuuccaaucccccuggagaaacuuuucaccggaccuuccucagccuucgugguccagccacagaacgguagauguacgacugacggcguguugcuggggaccacacaacuaaguccgguaaauauuugcacuuuuaggggagauguuacccauaucacaggcagccggaacuacaccaugaaucucgcaucucagaacuggaauaacuaugaccccacggaggaaauaccugcuccacuggguacucccgacuucguggggaagauucagggaguccuuacacagaccacucgcacagauggcuccacccgaggccacaaggccacgguguacaccgggucagcuaauuuuagcccuaagcugggaagaguccaauucgagacagacacugaucaugacuuugaagugaaccagaauaccaaauucacaccaguuggugugauccaggauggcgggacuacccacaggaacgagccccaacaguggguauugccgaguuacucuggacggaauacaccuaacguccaccucgccccagcaguggcccccaccuuuccuggcgaacagcuguuauucuuucguuccacuaugcccgguuguagcggguauccaaauauggaccuggauugccuccuuccucaggaguggguucaauacuucuaucaggaggcugcgcccgcacagucggacguggcccuguugcgcuuugucaacccagauacgggcagagugcuauucgaauguaagcugcauaaaucuggauacguaacaguggcucacaccggccagcaugaccucguuauuccgccuaacggguauuuuagguucgauuccugggucaaucaauucuacacucuggcccccaugggaaacgguaccggccggcgacgcgcacuuuga

SEQ ID NO: 19118 - RNA, 1623 nt, Artificial Sequence
  derived and/or modified sequence opt3 from capsid__Norovirus__BAQ20803
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcuaauuuuagcccuaagcugggaagagugcaauucgagacagauacugaccaugauuuugaaguuaaccagaauaccaaauucacaccaguggguguaauccaggacggcaguacuacccacaggaacgagccccaacagugggucuugccgucuuacuccgggcggaauacaccuaacgugcaccucgccccagcaguugcccccaccuuuccuggagaacagcuguuauucuuucguagcacuaugcccggcuguucggguuauccaaauauggaucuggacugccuccuuccucaggagugggugcaauacuucuaucaggaggcugcgcccgcacagucugaugucgcccuguugcgcuuugugaacccagacacggggagaguacuauucgaauguaagcugcauaaauccggcuacgugacaguugcucacaccggacagcaugaucucgucauuccgccuaacggcuauuuuagguucgacucaugggugaaucaauucuacacucuggcccccauggggaacggaaccggucggcgacgcgcacuuuga

SEQ ID NO: 19119 - RNA, 1623 nt, Artificial Sequence
  derived and/or modified sequence opt3 from capsid__Norovirus__BAQ20805
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacaggagaaucccggaccaaaccuuucucuguccccguguuaacuguugaggaaaugacaaauagccgcuuuccaaucccccuggagaaacuuuucaccgguccuuccucagccuucgugguccagccacagaacggcagauguacgacugaugggguguugcugggaaccacacaacuaaguccgguaaauauuugcacuuuuaggggcgacguuacccauacaaccgguagccacaacuacacgaugaaucucgcaucucagaacuggaauaacuaugaucccacugaggaaaucccugcuccacuggggacacccgacuucgugggaaagauacagggcaugcuuacccagacuacacggaccgacggcuccacgcgcgggcauaaggccaccgucuacacaggaucagcugauuuugccccuaagcugggucgagugcaauucggcacugacaccgaucacgacuuggaggcaaaucagaacacaaaauuuacuccagucggggugauucaggauggaagcaccacacacagaaaugaaccccaacaguggguucucccgaguuacucuggcaggaacaccccuaaugugcaucuggccccagcuguagcgcccacuuucccuggugagcaguuacuguuuuuccgguccacgaugcccggguguagcggcuauccaaacauggaccucgauugccuucugccucaggaauggguccaauacuuuuaucaggaggcagcccccgcucagucggacguggccuugcuacguuucguuaauccagauacaggacgcgugcuguuugaguguaagcuccacaaaucuggcuacgucaccguggcacauacugggcagcacgaccugguaaucccgccuaacggauauuucagauuugauuccugggugaaccaauucuacacccuugcccccauggguaauggcacagggaggcggcgagcucuguga

SEQ ID NO: 19120 - RNA, 1647 nt, Artificial Sequence
  derived and/or modified sequence opt3 from capsid_protein__Norovirus__AAB06271
augaagauggccagcaacagagcugcacccuccaaugacggcgccgcgugccuggugccugagaucaacaaugaagcuauggcccucgagccagucgcaggggccgcuauugcagccccgcuuaccggacagcaaaacauaaucgaucccuggauuaugaauaacuucguucaggcuccugguggcgaauuuacagugucuccaaggaacucacccggggagguacuguugaauuuagaacugggaccugagaucaauccauaccuagcccaccucgcgcggauguauaacggcuacgccgguggguucgaggugcaggucgugcuggcaggaaaugcuuuuacugccgcaaaaauuaucuucgcugccauacccccuaacuuuccaaucgacaaucuuagugcggcccagauuacgauguguccgcauguuaucguggauguccgccaacuggaacccauuaacuugccuaugccagacgugcgaaauaacuucuuucacuauaaccagggcagcgauucccgucucagacugaucgcaaugcuguacacaccccucagggcuaauaacucuggcgacgauguauucaccguuucgugccggguguuaacucgcccuucaccagacuuucuguucaauuuucuugugcccccgaccgucgagagcaagacaaaaccuuucaccuugcccauacugacuauuagugaaauguccaacucuagauuuccagugccuaucgauagccuacauacaucccccaccgagaauauugucguucagugucagaacgggagggugacgcucgacggagagcugauggguacuacccaacuucugccaucacagaucugcgccuuccggggcacauugacugggaguaccagccgcgcuucugaucaggccgacacacccaccccucgacucuucaaucaccauuggcacauccagcuggauaacuuaaauggaacgccauaugacccggcagaagacauucccgccccucugggcacuccagauuuuagagguaagguauucgggguggcuggacaaaggaaccccgacuccacaacccgggcgcacgaggcaaaagucgauacuacaucaggccguuuuaccccuaagcucggcagccuugaaauaacgaccgagagugacgaucuggacuugucucagccaacaaaguucacucccguggggaucggaguugauaaucgcgccgaauuucagcaauggucccuaccggacuacagcggucaguucacccauaacaugaaucuggcuccugccguggcaccaaacuuucccggcgagcagcuccuguucuuuagaucgcagcuuccuucuuccgggggaaggucaaauggcguccuggauuguuuggugccccaagaguggguacagcacuucuaucaggaaagugccccagcucagacacaaguugcccucgugcgguacgucaacccugacacuggucgagugcuguuugaggcaaaauuacauaagcugggguucaugaccgucgcgaaaaacggcgauagccccauuacagugccaccgaauggauacuuucgcuucgaauccuggguuaacccuuucuauacccuagcucccaugggcacugggaauggaagaaggcggauccaguga

SEQ ID NO: 19121 - RNA, 1620 nt, Artificial Sequence
  derived and/or modified sequence opt3 from capsid_protein__Norovirus__AAK96218
augaagauggccagcuccgacgcuaaccccucugauggcucaaccgcaaaucuggugccugaggucaacaaugaaguuauggcccucgagccagugguaggggcggcuaucgccggaccgguggcaggucagcaaaacgucauugaccccuggauaagaaauaacuucgugcaggccccuggcggggaauuuacaguuaguccaacuaaugcucccggagagauccuuuggagcgcaccucugggcccagauuugaaccccuacuuaucccaccuggccaggauguauaaugguuacgcugggggauucgaagugcaggucauucuagccggcaacgcguuuacggcaggcaaaaucauuuucgccgcugugccuccaaauuuuccgaccgaggggcucucucccucgcagguaacaauguucccucauaucauaguugacgugcggcaacuggagccaguccuuaucccccugccugaugcccgcaacaauuuuuaucacuacaaccagucaaaugacagcacuauuaaguugaucgcaaugcucuauaccccacugcgagcuaacaacgccggagaugacguguucacagugaguugccguguccugaccagacccuccccggauuuugacuucauuuuucucguuccucccacuguggaaucuaggacaaaaccauucaccguaccuaucuuaacgguggaggaaaugagcaauucccgguuucccauaccacuggagaaacuuuacacuggucccucaagugucuucgugguucagccucagaacggccgcuguaccacagaugggguguugcugggaacuacccaacuaagcgcggucaauauuugcacauucagaggcgacgugacccauaucgccgguucucacgauuauacgaugaaccucgcaucccagaauuggaacaauuacgacccaacugaggaaauuccggcuccccuggggacaccugacuuuguaggaaagauccagggcaugcuuacccagacuacaagggaggauggcucaacccgggccacgaaggcuaccguuagcacagggagugugcauuucacuccaaagcugggaucuguccaauacaccgccgacacaaacaaugauuuucagacuggucagaacaccaaauucacacccgugggcgucauccaagacggguccaaucaccagaacgaaccucagcaguggguguugaccaauuauagcggacgcacuggccacaacguucaucucgcaccagccguggcucccacguuuccgggugagcaacuguuauucuuucgaucgacaaugccuggguguucuggcuacccaaauaugaaccuggauugccuccuuccccaggaauggguacagcacuucuaucaggaggcggccccugcacaauccgacgucgcucuguugagauuugugaaccccgauaccggaaggguucuauucgaguguaagcugcauaaaucaggcuacgugacugucgcccacaccgggccacacgaccucgugauuccucccaauggauauuuucgguucgauccauggguaaaccaguuuuacacacuggcaccgauggguaauggcgccgggcgucgcagagcucuuuga

SEQ ID NO: 19122 - RNA, 1623 nt, Artificial Sequence
  derived and/or modified sequence opt3 from capsid_protein__Norovirus__AAR97648
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaaacugggcagaauaccaaguucacaccagucggagugguccaggauggcaacgguacccaccaaaaugagccccagcaguggguguugccgucuuacuccgggagaacuggccauaacguucaccucgcuccugccguggcaccaacguuucccggagaacagcuguuauucuuuaggucaacaaugccuggcuguagcggguaccccaacaugaaucuggacugccuccuuccacaagaguggguacagcauuucuaucaggaggccgcuccugcgcagagugaugucgcacuguugcgguuugugaaccccgacaccggacguguucuauucgaauguaaacugcacaagucugguuacgugacugucgcccacaccggccaacaugaucucgugauuccaccgaauggguauuuucgcuucgacuccuggguaaaccaguucuacacacuggcuccuaugggaaauggcaccgguagaaggcgggcccuuuga

SEQ ID NO: 19123 - RNA, 1623 nt, Artificial Sequence
  derived and/or modified sequence opt3 from capsid_protein__Norovirus__AAR97651
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucguguucgcugccguaccuccaaacuuuccgacggagggccucucccccucucagguuaccauguucccucauauuaucguggacguccgccaacuggagccagugcuuauaccccugccugaugugcgaaauaacuuuuaucacuacaaucagucgaacgacccaacaaucaaguugauugcaaugcucuauacuccccugcgugcuaacaaugccggggaagaugucuucaccguuucaugcagagugcugacaaggccgagcccugacuuugauuucaucuuucucguacccccaaccguggagagucggacuaaaccuuucacaguccccauuuuaaccguggaagagaugacgaacucccgcuuuccaaucccccuggagaaacuuuucacuggaccuucuagcgcguucguugugcagccacagaaugguagauguaccacagacggcgucuugcuggggacuacccaacuauccccggugaacauaugcacauuuaggggagauguaacccauauugccggcacgcacaauuacacuaugaaccucgcaucacagaauuggaacaauuaugaccccacagaagagaucccugcuccacuggguacccccgauuucguugggcggauucagggaaugcuuacucagacaacccgcggcgacggcaguacgcgagggcauaaggccaccgugagcacaggagacguccacuuuacuccuaagcuggguucuauccaauucaacaccgauacaaauaacgacuuugaaacuggccagaauaccaaguucacaccagugggggucgugcaggauggaaacggcacccaccaaaaugagccccagcaguggguuuugccguccuacucagguagaacugggcauaacgugcaccucgcuccugccguagcaccaacguuucccggcgaacagcuguuauucuuuaggagcacaaugccuggauguaguggcuaccccaacaugaaucuggacugccuccuuccacaagaguggguccagcauuucuaucaggaggccgcuccugcgcagucugauguggcacuguugcgguuuguuaaccccgacaccgggcgugugcuauucgaauguaaacugcacaaguccggauacgucacuguggcccacaccggucaacaugaucucguaaucccaccgaauggcuauuuucgcuucgacagcugggugaaccaguucuacacacuggcuccuauggggaauggaaccggcagaaggcgggcccuuuga

SEQ ID NO: 19124 - RNA, 1623 nt, Artificial Sequence; identical to SEQ ID NO: 19122
  derived and/or modified sequence opt3 from capsid_protein__Norovirus__AAR97654

SEQ ID NO: 19125 - RNA, 1623 nt, Artificial Sequence; identical to SEQ ID NO: 19122
  derived and/or modified sequence opt3 from capsid_protein__Norovirus__AAR97657

SEQ ID NO: 19126 - RNA, 1623 nt, Artificial Sequence; identical to SEQ ID NO: 19122
  derived and/or modified sequence opt3 from capsid_protein__Norovirus__AAR97660

SEQ ID NO: 19127 - RNA, 1623 nt, Artificial Sequence
  derived and/or modified sequence opt3 from capsid_protein__Norovirus__AAR97663
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucaguugaacgacccaacaauuaagcucaucgcaaugcuguauacuccccugcgugcuaacaaugccggggaagauguguucaccgucucgugcagaguucucacaaggccgucaccugacuuugauuucaucuuuuuagugcccccaaccguagagagccggacuaaaccuuucacagugcccauucugaccgucgaagagaugacgaacagucgcuuuccaauaccccuugagaaguuguucacuggaccuuccggugcguucgugguucagccacagaauggcagauguaccacagacggggugcugcuaggaacuacccaacucucuccggucaacauuugcacauuuaggggcgaugugacccauaucgccgguacgcacaauuacacuaugaaccuggcaagccagaauuggaacaauuaugaccccacagaagagauuccugcuccacuugggacccccgauuucguaggacggauccagggcaugcugacucagacaacccgcggcgacggguccacgcgaggacauaaagccaccguuucaacaggugacgugcacuuuacuccuaaguugggcaguauccaauucaacaccgauacaaauaacgacuuugaaacugggcagaauaccaaguucacaccagucggagugguccaggauggcaacgguacccaccaaaaugagccccagcagugggugcucccgagcuacucugggagaacuggccauaacguucaccuggcuccugccguggcaccaacguuucccggagaacaguuacuguucuuuagguccacaaugccuggcuguucaggguaccccaacaugaaucucgacugccuucugccacaagaguggguacagcauuucuaucaggaggccgcuccugcgcagagcgaugucgcauugcuacgguuugugaaccccgacaccggacguguucuguucgaauguaaacuccacaagagugguuacgugacugucgcccacaccggccaacaugaucuggugauuccaccgaauggguauuuucgcuucgacucuuggguaaaccaguucuacacacuugcuccuaugggaaauggcaccgguagaaggcgggcccuguga

SEQ ID NO: 19128 - RNA, 1623 nt, Artificial Sequence
  derived and/or modified sequence opt3 from capsid_protein__Norovirus__AAS86774
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggagaucuuguuaaaucuggaacuaggaccugagcucaacccauaccuggcccaccuugcucggauguauaauggcuacgccgguggggucgaggugcagguucuguuggcgggaaacgcauucacggccggcaaacucguguuugcugccauucccccucauuucccagucgauaaucugagcccgggccagaucaccauguuuccccacgugauuaucgacguacgcacacuggaaccuguucucuuaccacugcccgaugugcgaaacaauuucuuucauuauaaccagcaauccgaccagcguaugagacuugucgcaauguuguacacuccucugaggucuaacgggucgggagaugacguguucaccgugucaugccggguccuaacacgcccaagccccgauuuugacuucaauuaucucguuccgccuaccguggagaguaagacuaaacccuuuuccguaccagugcugacacuuaacgaacugaccaauucuagauucccuguccccguggaugcuauguacacgagcccaaacgacuccauaguugugcagccccagaaugguagggccacuaucgauggcgaguugcucgggaccacacaacugauuccuucaggaaucuguaguuuucggggcaagauuacuacccacuuaagcgacgaccgccaucuguggaacauccaggucucuaaucucaacgguacaccauucgauccgaccgacgaugugcccgcgccucuugggaugccagacuucuccggacagauauuuggcguaguuucacagcgagauacgggcacuaaucccgccaacagagcacacgacgcugugcuggccacauauagcgcuaaauacaccccuaaguuggggaguguccaaauuggaacuugggauacagacgaucuacuggagaggcagccagugaaguucacccccgucggucucaaugaaaucggccaggacaaacacuuugaucaaugggugcugccgaacuacucuggggcccuuggacugaauaugcauuuggccccugcaguuuccccacucuuccccggcgagcggcuguuauuuuuccguagcuauauuccucugaagggugggcacggcgaccccuuuaucgacugccuagugccacaggaauggauccagcauuucuaccaggagucggcuccugcgcaaucuuccguagcacuccugcgcuaugucaaccccgauacgggaagaacccuuuuugaagccaaauugcacaaggagggcuucauuacagugucaaguacugagaauaggccaguuauagugccgccuaacggguacuuucgguucgacagcugggucaaccaguuuuauucccuggcucccaugggaaccgguaauggccgacgcagaaugcaguga

SEQ ID NO: 19129 - RNA, 1623 nt, Artificial Sequence
  derived and/or modified sequence opt3 from capsid_protein__Norovirus__AAS86777
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggaggucuuguuaaaucuggaacuaggaccugagcucaacccauaccuggcccaccuugcucggauguauaauggcuacgccggugggguggagguucaggugcuguuggcgggaaacgcauucacggccggcaaacucgucuuugcugccaucccuccucauuucccaguggauaaucugagcccgggccagauuaccauguuuccccacguaaucauugacguucgcacacuggaaccugugcucuuaccacugcccgauguccgaaacaauuucuuucauuauaaccagcaauccgaccagcguaugagacuuguggcaauguuguacacuccucugaggucuaacgggucgggagaugacguguucaccgucucaugccggguucuaacacgcccaagccccgauuuugacuucaauuaucucgugccgccuaccguagagaguaagacuaaacccuuuuccgugccaguccugacacuuaacgaacugaccaauucuagauucccugugcccaucgaugcuauguacacgagcccaaacgacuccauaguugugcagccccagaaugguagggccacuaucgauggcgaguugcucgggaccacacaacugauuccuucaggaaucuguaguuuucggggcaagauuacuacccacuuaagcgacgaccgccaucuguggaacauccaggucucuaaucucaacgguacaccauucgauccgaccgacgaugugcccgcgccucuugggaugccagacuucuccggacagauauuuggcguaguuucacagcgagauacgggcacuaaucccgccaacagagcacacgacgcugugcuggccacauauagcgcuaaauacaccccuaaguuggggaguguccaaauuggaacuugggauacagaggaccuacuggaaaggcagccagugaaguucacccccgucggucucaaugagaucggccaggauaaacacuuugaccaaugggugcugccgaacuacucuggggcccuuggacugaauaugcauuuggcacccgccguuuccccacucuuccccggcgaacggcuguuauuuuuccguagcuauauuccucugaaggguggguacggcgaucccuuuaucgacugccuagugccacaggaguggauccagcacuucuaucaggaaucggcuccugcgcaaucuuccguagcacuccugcgcuacgucaaccccgacacgggaagaacccuuuuugaggccaaauugcauaaggagggcuucauuacagugucaaguacugaaaauaggccaguuauagugccgccuaacggguauuuucgguucgauagcugggucaaccaguuuuacucccuggcucccaugggaaccgguaauggccgacgcagaaugcaguga

SEQ ID NO: 19130 - RNA, 1623 nt, Artificial Sequence
  derived and/or modified sequence opt3 from capsid_protein__Norovirus__AAS86780
augaugauggccagcaaggacgcucccaccuccccugauggcgcaucuggggccggacagcuggugccagaggcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguaucauaauucuucgcagccucaaccaacuaugcgucucguagcuauguuauacacaccccugagaaccgggggagguucaggcgggacggaugccuucguuguggcgggaaggguccuuacuugcccugccccagacuuuagcuucuuguuucuggugcccccgaguguggagcagaagacccgggucuucuccguuccuaacauuccccuaaaagaucucucuaauagccgcgugccaguaccuauccagggcauguuuaugucccccgacgugaaccagucaguccaauuccagaaugguagaugucagauagaugggcaacugcagggaacaacuccagugagucuuagccagcugugcaagauuaggggcaaaaccucuuccaacgcacggguuuugaaccucucagagguggacggcacacccuucgucccucuggaaagcccagcuccggugggguuucccgacuuaggagguugugauuggcacguaaauuucaccuuucaggcccaaaaccaggacccuagucagucuguuacguucgcuacuaaugaugccuccuuugugccauaucugggcagcaucucgccccauaacgggggagacuuccacgcaggcgauauuaucgguucucucggguggaucuccgccccuucagacaauacacagcuuaacgucuggaccauuccaaaguacggcaguagccugcccgaugugacucacuuggcuccggcggucuuuccuccaggauucggcgaggugauacuauauuuuuacuccacauuccccgggucuggacaaccuagccagcugcagguucccugccuccugccacaggaauuuaucacccauuucuguaaugagcaagcaccuauugccggugaggcugcccuucugcacuauguggaccccgauacgggccgcaacuugggggaauuuaagcucuacccagacggauucaugaccugcguaccuaauucagucaguuccggcccgcagacacugcccaucaacgguguguucguuuuugugagcugggucucucgauucuaccaguuaaaaccaguggggacugcaucagccgcuagaaggcugggccuacggcguauauga

SEQ ID NO: 19131 - RNA, 1623 nt, Artificial Sequence
  derived and/or modified sequence opt3 from capsid_protein__Norovirus__AAS86783
augaugauggccagcaaggacgcucccaccuccccugauggcgcaucuggggccggacagcuggugccagaagcgaacacagcugaacaaaucucaauggacccggucgccggugcaaguacugccguugcuacggcaggccaggugaauaugauugaucccuggauauucaacaauuuuguacaggccccucagggggaguucaccaucagcccaaacaauacacccggagacauucucuuugaucuucaacugggcccucacuugaacccauucuuagcucaucugucccagauguacaaugguuggguggggaacaugagagucaggauccuacucgccggaaaugcguuuacugcaggcaaaauuaucauaugcugugugcccccuggcuucgacgcccggauccugaccauugcucaggccacacuuuuuccacaccugaucgcagauguucgcaccuuggaaccgguggagcucccccuggaagacguccgaaacgugcuguuccauaauucuucgcagccucaaccaacuaugcgucucguagcuauguuauauacaccccugagaaccgggggagguucaggcgggacggaugccuuuguuguggcgggaaggguccuuacuugcccugccccagacuucagcuuuuuguuccuggugcccccgaguguggagcagaagacccgggucuuuuccguuccuaacgugccccuaaaagaucucucuaauagccgcguaccagugccuauucagggcauguucaugucccccgacgucaaccagucagugcaauuccagaaugguagaugucagaucgaugggcaacugcagggaacaacuccaguuagucuuagccagcugugcaagauaaggggcaaaaccucuuccaacgcacggguguugaaccucucagaggucgacggcagccccuuuauuccucuggaaaguccagcuccggugggguuccccgacuuaggagguugugauuggcacguaaauuuuacauuccaggcccaagaccaggauccuucucaguccguuaccuuugcuacgaacgacgccagcuucgugccauaccugggcucgaucucuccccauaaugggggagauuuucacuccggcgacauuaucgguucacucggguggaucagugcaccuagcgauuccucucagcuuaacgucuggacuauuccaaaguauggcagcucacugcccgacgugacacacuuggccccggcugucuucccuccaggauuuggcgaggugauacuauacuucuauaguaccuuucccggguccggacaaccuguucagcuccaggugcccugccugcugccacaggaguucaucacucauuuuuguaaugaacaagcgccuauugcuggugaggccgcacuucugcacuacguagaucccgacacaggccgcaacuugggggaguucaagcucuauccagauggauucaugaccugcgucccgaauagcgugucuucaggcccucagacgcugcccaucaacgguguuuuuguguucgucaguugggugagccgauuuuaccaguuaaaaccaguagggaccgccuccguggcaagaaggcugggccuacggcguauauga

SEQ ID NO: 19132 - RNA, 1623 nt, Artificial Sequence
  derived and/or modified sequence opt3 from capsid_protein__Norovirus__AAS86786
augaagauggccagcaacgacgcugcacccuccaaugauggcgccaccgggcuggugccugagaucaacaaugaaacacucccacuugagccggucgcgggagcugccauugcagcccccguuacuggucagaacaauauaaucgacccuuggauuagaacgaacuucgugcaagcuccaaauggcgaauuuaccguaucucccaggaacucaccuggggagauccuguugaauuuagaacugggaccagaucuaaaccccuaccucgcacaccugagucggauguauaauggcuacgccggugggguggagguccaggugcuucuggcuggaaacgccuucacagcgggcaagauuuuguuugcagccguuccuccaaauuucccgguggaguuucucagccccgcucagaucacuaugcugccucaucugauagucgacgugcgcacccucgaaccaaucaugauucccuuaccugauguacgaaacacauucuuucacuauaauaaccagccagccaaccguaugagacugguugcaaugcuuuacacccccuugagguccaauggcucuggggacgauguguucacugucucgugccgggugcugacacgcccgaccccugacuuugaguucacguaucuagugcccccaucagucgaaagcaagacuaaaccuuuuagucuccccauccugaccauuuccgagcuuacaaacucuagauucccagcucccaucgauagccuguuuacugcccaaaauaacaauuugaacguucagugucagaauggaaggugcacccucgacggugagcugcagggcacaacccaauuacugccuuccgggauaugugcguuccggggacgccucacggccgauguggacggcucacaugaugaccgauggcacaugcagcuuacuaaccugaaugguacaccauucgacccgaccgaagauguacccgcaccuuuggggacuccagacuuuacaggacuacuguucggcguggcuagucagagaaacgucggcagcaaucccaacaccacgagggcccaugaggcugugguuucuaccacauccucacaguuugugccuaagcucgggagcgucaauuucggaaguacuucuaccgauuuucaacugcagcagccaacaaaauucacucccguggguauuaagaucgaauccggccacgaguuugaccaaugggcccuuccgcgguacagcgggcaccugaccuugaacaugaaucucgcaccuccaauugcccccaacuucccuggagaacagcuguuauuuuuccguucgaacguacccugcgcuggcgguguuucugauggggugaucgacugucugcuaccacaggaguggauccagcauuuuuaucaagaguccgcgccuucacagagugaugucgcacucauucgcuacgugaaucccgacacaggcagaacccuguucgaagccaaacuucacaggacuggauacauaacggucgcucauagcggcgauuauccauuggugguuccguccaacggguacuuucgguucgacucuugggugaaucaguucuauagccuggccccuaugggaacagguaacggccgacgcagaguacaguga

SEQ ID NO: 19133 - RNA, 1623 nt, Artificial Sequence
  derived and/or modified sequence opt3 from capsid_protein__Norovirus__AAS86792
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggagaucuuguuaaaucuggaacuaggaccugagcucaacccauaccuggcccaccuugcucggauguauaauggcuacgccgguggggucgaggugcagguucuguuggcgggaaacgcauucacggccggcaaacucguguuugcugccauucccccucauuucccagucgauaaucugagcccgggccagaucaccauguuuccccacgugauuaucgacguacgcacacuggaaccuguucucuuaccacugcccgaugugcgaaacaauuucuuucauuauaaccagcaauccgaccagcguaugagacuuauagcaauguuguacacuccucugaggucuaacgggucgggagaugacgucuucaccgugucaugccgggugcuaacacgcccaagccccgauuuugacuucaauuaucucgucccgccuaccguugagaguaagacuaaacccuuuuccgugccaguacugacacuuaacgaacugaccaauucuagauucccugugcccaucgaugcuauguacacgagcccaaacgacuccauugucgugcagccccagaaugguagggccacuaucgauggcgaguugcucgggaccacacaacugauuccuucaggaaucuguaguuuucggggcaagauaacuacccacuuaagcgacgaccgccaucuguggaacguucaggugucuaaucucaacgguacaccauucgauccgaccgacgauguccccgcgccucuugggaugccagacuucuccggacagauuuuuggcgugguaucacagcgagauacgggcacuaaucccgccaacagagcacacgacgcuguucuggccacauauagcgcuaaauacaccccuaaguuggggagugugcaaaucggaacuugggauacagaggaccuacuggaaaggcagccagucaaguucacccccgugggucucaaugagauuggccaggauaaacacuuugaccaauggguccugccgaacuacucuggggcccuuggacugaauaugcauuuggccccugcaguguccccacucuuccccggcgaacggcuguuauuuuuccguagcuauaucccucugaagggugggcacggcgaucccuuuaucgacugccuaguuccacaggaguggauucagcauuucuaccaggaaucggcuccugcgcaaucuuccguggcacuccugcgcuauguaaaccccgacacgggaagaacccuuuuugaggccaaauugcacaaggagggcuucauaacagucucaaguacugaaaauaggccagugaucguuccgccuaacggguacuuucgguucgauagcugggugaaccaguuuuauucccuggcucccaugggaaccgguaauggccgacgcagaaugcaguga

SEQ ID NO: 19134 - RNA, 1623 nt, Artificial Sequence
  derived and/or modified sequence opt3 from capsid_protein__Norovirus__AAS86795
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggagaucuuguuaaaucuggaacuaggaccugagcucaacccauaccuggcccaccuugcucggauguauaauggcuacgccgguggggucgaggugcagguucuguuggcgggaaacgcauucacggccggcaaacucguguuugcugccauucccccucauuucccagucgauaaucugagcccgggccagaucaccauguuuccccacgugauuaucgacguacgcacacuggaaccuguucucuuaccacugcccgaugugcgaaacaauuucuuucauuauaaccagcaauccgaccagcguaugagacuugucgcaauguuguacacuccucugaggucuaacgggucgggagaugacguguucaccgugucaugccggguccuaacacgcccaagccccgauuuugacuucaauuaucucguuccgccuaccguggagaguaagacuaaacccuuuuccguaccagugcugacacuuaacgaacugaccaauucuagauucccuguccccauagaugcuauguacacgagcccaaacgacuccaucgugguucagccccagaaugguagggccacuauugauggcgaguugcucgggaccacacaacugaucccuucaggaauuuguaguuuucggggcaagaucacuacccacuuaagcgacgaccgccaucuguggaacauacaggugucuaaucucaacgguacaccauucgauccgaccgacgauguccccgcgccucuugggaugccagacuucuccggacagauuuuuggcgugguaucacagcgagauacgggcacuaaucccgccaacagagcacacgacgcuguucuggccacauauagcgcuaaauacaccccuaaguuggggagugugcaaaucggaacuugggauacagaggaccuacuggaaaggcagccagucaaguucacccccgugggucucaaugagauuggccaggauaaacacuuugaccaauggguccugccgaacuacucuggggcccuuggacugaauaugcauuuggccccugcaguguccccacucuuccccggcgaacggcuguuauuuuuccguagcuauaucccucugaagggugggcacggcgaucccuuuaucgacugccuaguuccacaggaguggauucagcauuucuaccaggaaucggcuccugcgcaaucuuccguggcacuccugcgcuauguaaaccccgacacgggaagaacccuuuuugaggccaaauugcacaaggagggcuucauaacagucucaaguacugaaaauaggccagugaucguuccgccuaacggguacuuucgguucgauagcugggugaaccaguuuuauucccuggcucccaugggaaccgguaauggccgacgcagaaugcaguga

SEQ ID NO: 19135 - RNA, 1623 nt, Artificial Sequence
  derived and/or modified sequence opt3 from capsid_protein__Norovirus__AAS86798
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggagaucuuguuaaaucuggaacuaggaccugagcucaacccauaccuggcccaccuugcucggauguauaauggcuacgccgguggggucgaggugcagguucuguuggcgggaaacgcauucacggccggcaaacucguguuugcugccauucccccucauuucccagucgauaaucugagcccgggccagaucaccauguuuccccacgugauuaucgacguacgcacacuggaaccuguucucuuaccacugcccgaugugcgaaacaauuucuuucauuauucccagcaaucugaccagcguaugagacuugucgcaauguuguacacuccucugaggucgaacgggucaggagaugacguguucaccgugagcugccggguccuaacacgcccaagucccgauuuugacuucaacuaucucguuccgccuaccguggaguccaagacuaaacccuuuucuguaccagugcugacacuuaaugaacugaccaacagcagauucccuguccccauagaugcuauguacacguccccaaaugacucaaucgugguucagccccagaacgguagggccacuauugauggcgaguugcucgggaccacacaacugaucccuaguggaauuuguagcuuucggggcaagaucacuacccacuuaucugacgaccgccaucuguggaauauacagguguccaaccucaaugguacaccauucgauccgaccgacgauguccccgcgccucuugggaugccagacuucucaggacagauuuuuggcgugguaagccagcgagauacgggcacuaaccccgccaauagagcacacgacgcuguucuggccacauauagugcuaaauacaccccuaaguuggggucugugcaaaucggaacuugggauacagaggaccuacuggaaaggcagccagucaaguucacccccgugggucucaacgagauuggccaggauaaacacuuugaccaauggguccugccgaauuacuccggggcccuuggacugaacaugcauuuggccccugcagugagcccacucuuccccggcgaacggcuguuauuuuuccguucguauaucccucugaagggugggcacggcgaucccuuuaucgacugccuaguuccacaggaguggauucagcauuucuaccaggaaucugcuccugcgcaauccucaguggcacuccugcgcuauguaaaucccgacacgggaagaacccuuuuugaggccaaauugcacaaggagggcuucauaacagucaguagcacugaaaacaggccagugaucguuccgccuaauggguacuuucgguucgauuccugggugaaccaguuuuauucucuggcucccaugggaaccgguaacggccgacgcagaaugcaguga

SEQ ID NO: 19136 - RNA, 1623 nt, Artificial Sequence; identical to SEQ ID NO: 19134
  derived and/or modified sequence opt3 from capsid_protein__Norovirus__AAS86801

SEQ ID NO: 19137 - RNA, 1623 nt, Artificial Sequence
  derived and/or modified sequence opt3 from capsid_protein__Norovirus__AAS86804
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggaggucuuguuaaaucuggaacuaggaccugagcucaacccauaccuggcccaccuuagccggauguauaauggcuacgcuggugggguggagguucaggugcuguuggccggaaacgcguucacggcaggcaaacucgucuuugccgcuauucccccucauuucccaguggauaaucuguccccgggccagaucaccauguuuccccacguaaucauugacguucgcacacuggaaccugugcucuuaccacugcccgauguccgaaacaauuucuuucauuauaaccagcaaucugaccagcguaugagacuuaucgccauguuguacacuccucugaggucgaacgggucaggagaugacguguucaccgugagcugccggguccuaacacgcccaagucccgauuuugacuucaauuaucucguuccgccuaccguggaguccaagacuaaacccuuuucuguaccagugcugacacuuaacgaacugaccaauagcagauucccuguccccauagaugcaauguacacguccccaaacgacucagugguugugcagccccagaaugguagggcuacuaucgauggcgaguugcucgggaccacacaacugauuccuaguggaaucuguagcuuucggggcaagauuacuacccacuuaucugacgaccgccaucuguggaacauccaggucuccaaucucaacgguacaccauucgauccgaccgacgaugugcccgccccucuugggaugccagacuucucaggacagauauuuggcguaauuagccagcgagauacgggcacuaaucccgcgaacagagcccacgacgcaguucuggcuacauauagugccaaauacaccccuaaguuggggucugugcaaaucggaacuugggauacagaggaccuacuggaaaggcagccagucaaguucacccccgugggucucaaugagauuggccaggauaaacacuuugaccaauggguccugccgaacuacuccggggcucuuggacugaauaugcauuuggccccugcagugagcccacucuuccccggcgaacggcuguuauuuuuccguucguauaucccucugaagggugggcacggcaaccccuuuaucgauugccuaguuccacaggaguggauucagcauuucuaccaggaaucugccccugcucaauccucaguggcgcuccugcgcuauguaaaucccgacacgggaagaacccuuuuugaggcaaaauugcacaaggagggcuucauaacagucaguagcacugaaaacaggccagugaucguuccgccuaacggguacuuucgguucgacuccugggugaaucaguuuuauucucuggcccccaugggaaccgguaacggccgacgcagaaugcaguga

SEQ ID NO: 19138 - RNA, 1593 nt, Artificial Sequence
  derived and/or modified sequence opt3 from capsid_protein__Norovirus__AAS86807
augaugauggccagcaaggacgcuaccuccaacguggauggcgcaucuggggccggacagcugguccccgaagcgaauacaucagacccucucgcuauggauccaguugccgguaguagcacugcaguggccacggcuggccaaguaaacccgaucgaccccuggauuauaaauaacuucgugcaggcaccucagggggaauuuaccaucuccccaaauaacacacccggagauguccuuuucgaccugucuuugggcccucacuuaaauccauuucugcuacaucucucgcagauguacaacgguuggguggggaauaugagaguuaggauuaugcuggccggaaacgcuuucacugccggcaaaaucauugugucaugcauacccccuggcuuugggagccacaaucuuaccaucgcgcaaaguacacuguucccacaugucaucgcagaugugcggaccuuggacccgauugagguaccccucgaagauguucgcaacgugcuguuucacaauaacgaccgaaaucagcagacuaugcgucuggucuguaugcucuauacaccuuuaagaaccggagguggcacgggggauuccuucgugguggccggaagggucaugacuugcccaucucccgacuuuaacuuccuguuucuuguuccuccaaccguggagcagaagacacggcccuucacuuugccgaaccugccucuaagcucccucucaaauagucgcgcuccccugccaaucagcucuaugggcauuuccccugauaacguacaaucagugcaguuucagaaugguagauguacccuugacgggaggcuggucggaacaacccccgugagcuugagucagguugccaaaauccggggcacgucuaacggcacugugauaaaucucacagaacuggacgggaccccauuccaucccuucgagggaccugcaccaauugguuuuccggauuuaggcgggugcgacuggcacgucaacaugacucaauucggacacuccagccagacacaguuugauguggacaccacgcccgagaccuucguaccucaucugggcucgauccaagcuaaugguguugggucuggcaacuacauuggagugcucuccuggaucucaccacccagucacccuagcggcucccaggucgaucuuuggaagaucccaaauuaugggucuagcauuacagaagccacucaucuggcgcccucaguguuuccgccuggauucggugaggucuugguguuuuucaugaguaaaauaccaggccccggggccuacaaccuaccuugucugcucccccaggaauauaucucccacuuugcaagcgagcaggcuccaaccguuggagaggccgcucugcuucacuacguggacccugauacaggccgcaaucugggugaguucaaggccuaucccgacggguuuuugacuugcguaccaaacggcgcaucuucaggaccgcaacagcucccuauuaauggcgucuucguguuuguuaguugggugagccgauucuaccagcugaagcccgucgggaccgccuccucugcuagaggaagguuaggucugcggcguuga

SEQ ID NO: 19139 - RNA, 1623 nt, Artificial Sequence
  derived and/or modified sequence opt3 from capsid_protein__Norovirus__AAT00237
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcgccuuuaggggcgaugugacacauaucgcagguacccacaauuacacgaugaaccucgcuucccagaauuggaacaauuaugaccccacugaagagauuccugccccacuggggacacccgauuucguaggacggauccagggcaugcuuacccagacuacacgcggcgacgggucaacccgaggacauaaggcuacgguuaguaccggugacgugcacuuuacaccuaagcugggcagcauccaauucaacacugauaccaauaacgacuuugaaacagggcagaauacuaaguucaccccagucggagugguccaggauggcaacgguacacaccaaaaugagccccagcaguggguguugccgucuuacuccgggagaaccggccauaacguucaccucgccccugcaguggccccaacuuuucccggagaacagcuguuauucuuuaggucaacgaugccuggcuguagcggguaccccaacaugaaucuggacugccuccuuccacaagaguggguacagcauuucuaucaggaggcugcgccugcacagagugaugucgcccuguugcgguuugugaaccccgacacaggacguguucuauucgaauguaaacugcacaagucugguuacgugaccgucgcucacacuggccaacaugaucucgugauuccaccgaauggguauuuucgcuucgacuccuggguaaaccaguucuacacccuggccccuaugggaaauggcacagguagaaggcgggcacuuuga

SEQ ID NO: 19140 - RNA, 1623 nt, Artificial Sequence; identical to SEQ ID NO: 19139
  derived and/or modified sequence opt3 from capsid_protein__Norovirus__AAT00240

SEQ ID NO: 19141 - RNA, 1623 nt, Artificial Sequence; identical to SEQ ID NO: 19139
  derived and/or modified sequence opt3 from capsid_protein__Norovirus__AAT00243

SEQ ID NO: 19142 - RNA, 1623 nt, Artificial Sequence; identical to SEQ ID NO: 19139
  derived and/or modified sequence opt3 from capsid_protein__Norovirus__AAT00246

SEQ ID NO: 19143 - RNA, 1623 nt, Artificial Sequence
  derived and/or modified sequence opt3 from capsid_protein__Norovirus__AAT00249
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcgccuuuaggggcgaugugacacauaucgcagguacccacaauuacacgaugaaccucgcuucccagaauuggaacaauuaugaccccacugaagagauuccugccccacuggggacacccgauuucguaggacggauccagggcaugcuuacccagacuacacgcggcgacgggucaacccgaggacauaaggcuacgguuaguaccggugacgugcacuuuacaccuaagcugggcagcauccaauucaacacugauaccaauaacgacuuugaaacagggcagaauacuaaguucaccccagucggagugguccaggauggcaacgguacacaccaaaaugagccccagcaguggguguugccgucuuacuccgggagaaccggccauaacguucaccucgccccugcaguggccccaacuuuucccggagaacagcuguuauucuuuaggucaacgaugccuggcuguagcggguaccccaacaugaaucuggacugccuccuuccacaagaguggguacagcauuucuaucaggaggcugcgccugcacagagugaugucgcccuguugcgguuugugaaccccgacacaggacguguucuauucgaauguaaacugcacaagaccgguuacgugacugucgcucacaccggccaacaugaucucgugauuccaccgaauggguauuuucgcuucgacucuuggguaaaccaguucuacacacuggccccuaugggaaauggcaccgguagaaggcgggcacuuuga

SEQ ID NO: 19144 - RNA, 1623 nt, Artificial Sequence
  derived and/or modified sequence opt3 from capsid_protein__Norovirus__AAT00255
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaaacugggcagaauaccagauucacaccagucggagugguccaggauggcaacgguacccaccaaaaugagccccagcaguggguguugccgucuuacuccgggaggacuggccauaacguucaccucgcuccugccguggcaccaacguuucccggagaacagcuguuauucuuucggucaacaaugccuggcuguagcggguaccccaacaugaaucuggacugccuccuuccacaagaguggguacagcauuucuaucaggaggccgcuccugcgcagagugaugucgcacuguugcguuuugugaaccccgacaccggacgcguucuauucgaauguaagcugcacaaaucugguuacgugacugucgcccacaccggccaacaugaucucgugauuccaccgaauggguauuuuagauucgacuccuggguaaaccaguucuacacacuggcuccuaugggaaauggcaccgguaggcggcgagcccuuuga

SEQ ID NO: 19145 - RNA, 1623 nt, Artificial Sequence; identical to SEQ ID NO: 19144
  derived and/or modified sequence opt3 from capsid_protein__Norovirus__AAT00258

SEQ ID NO: 19146 - RNA, 1623 nt, Artificial Sequence; identical to SEQ ID NO: 19144
  derived and/or modified sequence opt3 from capsid_protein__Norovirus__AAT00261

SEQ ID NO: 19147 - RNA, 1623 nt, Artificial Sequence; identical to SEQ ID NO: 19144
  derived and/or modified sequence opt3 from capsid_protein__Norovirus__AAT00264

SEQ ID NO: 19148 - RNA, 1623 nt, Artificial Sequence; identical to SEQ ID NO: 19144
  derived and/or modified sequence opt3 from capsid_protein__Norovirus__AAT00267

SEQ ID NO: 19149 - RNA, 1623 nt, Artificial Sequence; identical to SEQ ID NO: 19144
  derived and/or modified sequence opt3 from capsid_protein__Norovirus__AAT00270

SEQ ID NO: 19150 - RNA, 1623 nt, Artificial Sequence; identical to SEQ ID NO: 19144
  derived and/or modified sequence opt3 from capsid_protein__Norovirus__AAT00273

SEQ ID NO: 19151 - RNA, 1623 nt, Artificial Sequence; identical to SEQ ID NO: 19144
  derived and/or modified sequence opt3 from capsid_protein__Norovirus__AAT00276

SEQ ID NO: 19152 - RNA, 1623 nt, Artificial Sequence; identical to SEQ ID NO: 19144
  derived and/or modified sequence opt3 from capsid_protein__Norovirus__AAT00279

SEQ ID NO: 19153 - RNA, 1623 nt, Artificial Sequence; identical to SEQ ID NO: 19144
  derived and/or modified sequence opt3 from capsid_protein__Norovirus__AAT00282

SEQ ID NO: 19154 - RNA, 1623 nt, Artificial Sequence; identical to SEQ ID NO: 19144
  derived and/or modified sequence opt3 from capsid_protein__Norovirus__AAT00285

SEQ ID NO: 19155 - RNA, 1623 nt, Artificial Sequence; identical to SEQ ID NO: 19144
  derived and/or modified sequence opt3 from capsid_protein__Norovirus__AAT00288

SEQ ID NO: 19156 - RNA, 1623 nt, Artificial Sequence; identical to SEQ ID NO: 19144
  derived and/or modified sequence opt3 from capsid_protein__Norovirus__AAT00291

SEQ ID NO: 19157 - RNA, 1623 nt, Artificial Sequence; identical to SEQ ID NO: 19144
  derived and/or modified sequence opt3 from capsid_protein__Norovirus__AAT00294

SEQ ID NO: 19158 - RNA, 1623 nt, Artificial Sequence; identical to SEQ ID NO: 19144
  derived and/or modified sequence opt3 from capsid_protein__Norovirus__AAT00297

SEQ ID NO: 19159 - RNA, 1623 nt, Artificial Sequence; identical to SEQ ID NO: 19144
  derived and/or modified sequence opt3 from capsid_protein__Norovirus__AAT00300

SEQ ID NO: 19160 - RNA, 1623 nt, Artificial Sequence; identical to SEQ ID NO: 19144
  derived and/or modified sequence opt3 from capsid_protein__Norovirus__AAT00303

SEQ ID NO: 19161 - RNA, 1623 nt, Artificial Sequence; identical to SEQ ID NO: 19144
  derived and/or modified sequence opt3 from capsid_protein__Norovirus__AAT00306

SEQ ID NO: 19162 - RNA, 1623 nt, Artificial Sequence; identical to SEQ ID NO: 19144
  derived and/or modified sequence opt3 from capsid_protein__Norovirus__AAT00309

SEQ ID NO: 19163 - RNA, 1623 nt, Artificial Sequence; identical to SEQ ID NO: 19144
  derived and/or modified sequence opt3 from capsid_protein__Norovirus__AAT00312

SEQ ID NO: 19164 - RNA, 1623 nt, Artificial Sequence; identical to SEQ ID NO: 19144
  derived and/or modified sequence opt3 from capsid_protein__Norovirus__AAT00315

SEQ ID NO: 19165 - RNA, 1623 nt, Artificial Sequence; identical to SEQ ID NO: 19144
  derived and/or modified sequence opt3 from capsid_protein__Norovirus__AAT00318

SEQ ID NO: 19166 - RNA, 1623 nt, Artificial Sequence; identical to SEQ ID NO: 19144
  derived and/or modified sequence opt3 from capsid_protein__Norovirus__AAT00321

SEQ ID NO: 19167 - RNA, 1623 nt, Artificial Sequence; identical to SEQ ID NO: 19139
  derived and/or modified sequence opt3 from capsid_protein__Norovirus__AAT00324

SEQ ID NO: 19168 - RNA, 1623 nt, Artificial Sequence
  derived and/or modified sequence opt3 from capsid_protein__Norovirus__AAT00330
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaaacugggcagaauaccaaguucacaccagucggagugguccaggauggcaacgguacccaccaaaaugagccccagcaguggguguugccgucuuacuccgggagaacuggccauaacguucaccucgcuccugccguggcaccaacguuucccggagaacagcuguuauucuuuaggucagccaugccuggcuguagcggguaccccaacaugaaucuggacugccuccuuccacaagaguggguacagcauuucuaucaggaggcugcgccugcacagagugaugucgcccuguugcgguuugugaaccccgacacaggacguguucuauucgaauguaaacugcacaagucugguuacgugaccgucgcucacacuggccaacaugaucucgugauuccaccgaauggguauuuucgcuucgacuccuggguaaaccaguucuacacccuggccccuaugggaaauggcacagguagaaggcgggcacuuuga

SEQ ID NO: 19169 - RNA, 1623 nt, Artificial Sequence; identical to SEQ ID NO: 19168
  derived and/or modified sequence opt3 from capsid_protein__Norovirus__AAT00333

SEQ ID NO: 19170 - RNA, 1623 nt, Artificial Sequence; identical to SEQ ID NO: 19168
  derived and/or modified sequence opt3 from capsid_protein__Norovirus__AAT00336

SEQ ID NO: 19171 - RNA, 1623 nt, Artificial Sequence
  derived and/or modified sequence opt3 from capsid_protein__Norovirus__AAT00342
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcguccaauucaacaccgauacaaauaacgacuuugaaacugggcagaauaccaaguucacaccagugggagucgugcaggauggcaacggugcucaccaaaaugagccccagcaguggguuuugccgucuuacuccgggagaaccggccauaacgugcaccucgccccugcaguagccccaacuuuucccggagaacagcuguuauucuuuaggucaacgaugccuggcuguagcggguaccccaacaugaaucuggacugccuccuuccacaagaguggguccagcauuucuaucaggaggcugcgccugcacagagugauguggcccuguugcgguuuguuaaccccgacacaggacgugugcuauucgaauguaaacugcacaagucugguuacgucaccguggcucacacuggccaacaugaucucguaaucccaccgaauggguauuuucgcuucgacuccugggugaaccaguucuacacccuggccccuaugggaaauggcacagguagaaggcgggcacuuuga

SEQ ID NO: 19172 - RNA, 1623 nt, Artificial Sequence; identical to SEQ ID NO: 19144
  derived and/or modified sequence opt3 from capsid_protein__Norovirus__AAT00345

SEQ ID NO: 19173 - RNA, 1623 nt, Artificial Sequence
  derived and/or modified sequence opt3 from capsid_protein__Norovirus__AAT00348
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaaacugggcagaauaccagauucacaccagucggagugguccaggauggcaacgguacccaccaaaaugagccccagcaguggguguugccgucuuacuccgggaggacuggccauaacguucaccucgcuccugccguggcaccaacguuucccggagaacagcuguuauucuuucggucaacaaccccuggcuguagcggguaccccaacaugaaucuggacugccuccuuccacaagaguggguacagcauuucuaucaggaggccgcuccugcgcagagugaugucgcacuguugcguuuugugaaccccgacacuggacgcguucuauucgaauguaagcugcacaaaucugguuacgugaccgucgcccacacaggccaacaugaucucgugauuccaccgaauggguauuuuagauucgacuccuggguaaaccaguucuacacccuggcuccuaugggaaauggcacugguaggcggcgagcccuuuga

SEQ ID NO: 19174 - RNA, 1623 nt, Artificial Sequence; identical to SEQ ID NO: 19144
  derived and/or modified sequence opt3 from capsid_protein__Norovirus__AAT00351

SEQ ID NO: 19175 - RNA, 1623 nt, Artificial Sequence; identical to SEQ ID NO: 19144
  derived and/or modified sequence opt3 from capsid_protein__Norovirus__AAT00354

SEQ ID NO: 19176 - RNA, 1623 nt, Artificial Sequence; identical to SEQ ID NO: 19144
  derived and/or modified sequence opt3 from capsid_protein__Norovirus__AAT00357

SEQ ID NO: 19177 - RNA, 1623 nt, Artificial Sequence; identical to SEQ ID NO: 19144
  derived and/or modified sequence opt3 from capsid_protein__Norovirus__AAT00360

SEQ ID NO: 19178 - RNA, 1623 nt, Artificial Sequence; identical to SEQ ID NO: 19139
  derived and/or modified sequence opt3 from capsid_protein__Norovirus__AAT00363

SEQ ID NO: 19179 - RNA, 1623 nt, Artificial Sequence; identical to SEQ ID NO: 19144
  derived and/or modified sequence opt3 from capsid_protein__Norovirus__AAT00366

SEQ ID NO: 19180 - RNA, 1623 nt, Artificial Sequence; identical to SEQ ID NO: 19144
  derived and/or modified sequence opt3 from capsid_protein__Norovirus__AAT00369

SEQ ID NO: 19181 - RNA, 1623 nt, Artificial Sequence; identical to SEQ ID NO: 19144
  derived and/or modified sequence opt3 from capsid_protein__Norovirus__AAT00372

SEQ ID NO: 19182 - RNA, 1623 nt, Artificial Sequence; identical to SEQ ID NO: 19144
  derived and/or modified sequence opt3 from capsid_protein__Norovirus__AAT00375

SEQ ID NO: 19183 - RNA, 1647 nt, Artificial Sequence
  derived and/or modified sequence opt3 from capsid_protein__Norovirus__AAT70110
augaagauggccagcaaagacgcuacccccuccaacgauggcgcagccgggcuggugccugagaucaauaacgaagcgauggcucucgacccagucgccggagcagccauugcugcaccgcuuacaggucagcaaaauauaaucgaucccuggauuaugaacaauuucguucaggccccuggcggggaguuuacugugucuccaagaaacucacccggagaaguacuguugaauuuagagcugggcccugaaaucaacccauaccuagcucaccucgccaggauguauaaugguuacgcagggggauucgaggugcaggucgugcuggcgggcaacgccuuuacggcuggcaagauuaucuucgccgcaauacccccuaauuuuccaaucgacaaccuuagugcugcccagauuaccaugugcccgcauguuaucguggauguccggcaacuggagcccgugaauuugccuaugccagacguacgcaacaauuucuuucacuauaaccaggggagcgauucccgacuccgucugauugcgaugcuguacacaccccucagagccaacaauucuggagacgauguuuucacugugucguguagggucuuaacccggccuucaccagacuuuagcuucaacuuucuggugcccccgacaguggaaaguaaaaccaagccuuucacucuucccaucuugacaauauccgagaugucuaauagccgcuuuccagucccuauugauucccugcauaccucacccacggaaaacaucguugugcagugccagaaugguagaguaacucuagacggcgagcucauggggaccacacaacugcuuccaagucagauuugugcauucaggggagugcugacucggagcaccucucgcgcuuccgaucaggccgacacagcuacgccccgauuguucaacuauuacuggcacauccagcucgacaaucugaacggcaccccuuaugauccagccgaggacaucccgggucccuuagggacuccugauuuuagaggaaaagucuucggcguggcaucacaaaggaauccagacagcacaacccgggcccaugaagcuaagguugauacuacagcgggccguuuuacccccaagcuggggagucucgagauuucuacggaauccggagacuucgaucagaaccagccuacccgcuuuacaccaguggguauaggcgucgacaaugaggcagauuuccaacaguggagccuucccgacuacucggggcaguuuacucacaacaugaaucuggccccggcuguggccccuaacuucccaggagaacaguugcuauuuuucagaucucaacugcccuccucaggcgguaggaguaaugggauccucgauugccugguaccucaggaguggguucagcacuuuuaccaggagagcgcacccucccaaacccagguggcccuuguccgguaugugaacccagacacaggccgaguccuguucgaagcuaaauugcauaagcucggauuuaugacuauugccaaaaacggcgacucuccuaucaccgugcccccaaauggguacuuccgcuucgagagcuggguuaacccguuuuauacacuggcaccuaugggaaccgguaauggcagaaggcggauacaguga

SEQ ID NO: 19184 - RNA, 1623 nt, Artificial Sequence
  derived and/or modified sequence opt3 from capsid_protein__Norovirus__AAT73592
auggccagcaaggacgcugcacccuccaccgauggcgccgcggggcuggugccugagucuaacaaugaagucauggcucucgagccaguugccggagcagcccuugcugcaccggugacaggucagacuaacaucauugaccccuggauaagaacgaauuucguacaagccccuaacggcgaauuuaccgugucaccaaggaaugcucccggggagguccuguugaacuuagaacugggaccugagcuaaauccauaccucgcccaccuggcgcggauguauaacggcuacgccggugggauggaggugcagguuaugcuugcaggaaaugcuuucacagccggcaaacugguguuugcagcugugcccccucauuucccagucgaaaacuugaguccgcagcagaucacuauguuuccccacguaauuaucgauguucgcacccucgagccugugcugcugccacuccccgacguccgaaauaacuucuuucauuauaaucaaaaggaugacccuaaaaugcguauuguggccauguuauacacaccacugagaagcaacggcuccggggaugacguguucaccgucucuugcaggguucuuacucggcccucgccggauuuugacuucacauauuuggugccucccaccguagaaucaaagacgaaaccauuuacucugccuauccuaacccucggagagacaagcaauagucgcuuccccgugccaauagaucagauguacacuucccccaacgaggucaucucugugcagugucagaacgguagaugcacccuggacggcgaacuucaagggacaacccagcugcagguuagcggaauuugugcguuuaagggccaggugacggcccacuugcaagauaaugagcaucucuauaacgucacuaucacaaaucugaacgguuccccuuucgacccaucagaagacauuccggcacccuuaggggugccugauuucgagggaaggguauuuggcguuaucagucagcgggacaauuacaacagcggcgggcagaaucaaccagcuaaccgcucucacgaugccgugguccccaccuacacugcucaguauacaccuaagcugggacagauacagauugguaccuggcaaacggacgauaucaccguggaccagccagccaaauucacacccgucggccucuccgauacugaccacuuuaaucagugggugguuccgcgauacgcaggggcccuuaaccugaauaccaacuuggcuccuucaguggcgccaguauuccccggagaaagacuacuguuuuucaggagcuauauuccucucaagggcgguuuugggaaucccgcaaucgauugccuggucccacaggaguggauccaacauuucuaccaggaggccacaccuagucuuucugaaguggcucugguucgguauauuaaccccgacacuggccgugccuuguuugaggcaaaacuccaccgcgccggauucaugaccguguccagcaauacaucggcuccagucgugguaccggccaacggcuacuuuagauucgauucuugggugaaccaguuuuauucccuggcaccuauggggaccggaaaugguaggcggcgaauacaguga

SEQ ID NO: 19185 - RNA, 1614 nt, Artificial Sequence
  derived and/or modified sequence opt3 from capsid_protein__Norovirus__AAT78480
auggccagcaaggacgcugcacccuccaacgauggcgccaccgggcuggugccugagaucaauacagaaacucucccacuugagccggucgcgggagcugccauugcagcccccguuacgggucagaacaauauaaucgacccuuggauuagaaacaauuucgugcaagcuccaaacggcgaauuuaccguaucuccccguaauucaccuggggagauccugaugaacuuggaauuaggaccagaucugaaucccuaccuagcacaccucagucggauguauaacggcuacgccggugggguggagguccaggugcugcuugcuggaaaugccuucacagcgggcaaaauucuguuugcagccguuccuccaaacuucccgguggacauguugagccccgcucagaucacuaugcucccucaucugauagucgaugugcgcacccuggagccaaucaugauuccccucccugacguacgaaaugucuuuuaucacuucaacaaucagccagcccccaggaugagauuaguggcaaugcuguacacaccgcuuagguccaacggcucuggggaugacgucuuuaccgugucgugccggguguugacucgcccuacacccgauuucgaauuuaccuaucuggucccaccuucaguugagagcaagacgaaacccuucacucuaccaauccucaccauuggagaacugacaaacaguagauuucccgcuccuaucgaccaacuuuacacuuccccaaaugccgaugugguagugcagccgcagaacgguagguguucucuggacggcgaguugcaggggaccacacaacuccugaccacggcgauaugcagcuaucggggaaugacuuccaaucccacacgcgauuacugggacggccauuuacugcaccucguccauccuaacggugccaccuacgacccaacugaggaugugcccgcaccuuucgggacacaggacuuucgaggcauucuuuauggaguucugacccagaauccaagagcuucaggcgaugaagccgcuaacagucaggggguguacaucagcucuacguccgagaaguucacccccaaauugggaacaauuggucuacaccaaguccagggccaccauucacagcaccaacagagcaaguucacuccgcuggggguggccguaaauggaaacaccccuuuuaggcagugggaacucccaaauuauaguggcgcacugacacuuaacacuaaucuggcccccgcuguugguccuaacuuccccggggagcagaucuuguuuuuccggucuaaugugccauccguccaaggcggacagccuaucgaaauugacugucucauaccccaggagugggugagccauuuuuaccaggagucggcgccaucucaauccgaugucgcacuggugcguuauguuaacccggacaccggccgcacaaucuucgaagccaaguuacacagacagggguuuauuaccaucgcugccacuggaucaaauccugugguaguucccccaaacgguuacuucagguuugauaguugggugaaccaguucuaugcacuggcccccaugggcacggggaauggacggcgacgcauacaguga

SEQ ID NO: 19186 - RNA, 1635 nt, Artificial Sequence
  derived and/or modified sequence opt3 from capsid_protein__Norovirus__AAT78481
auggccagcaaggacgcucccuccaacauggauggcaccucuggggcaggacagcuggugccugaggccaauacagcggacccaauuccgcucgaacccgucguuggugcugccacugcagccgcuacggcaggccaagugaacaugauugauccuuggauaaugaauaacuucguacagucaccagagggggaauuuaccaucagucccaauaacacaccuggagacauucuuuucgaucugcaguugggcccacacuuaaaucccuuucugcagcaucuaagccaaauguacaacgguuggguggggaauaugagagucaggauccuccuggccggaaacgcuuucuccgccggcaaaauuaucauaugcugugugccuccaggcuuuacugcgcagaauaucucuauugcacaggccaccauguucccgcacguuaucgcugacgugcggguccuugagcccauugaaaucccucuggaugacgugcgcaacguauuguuucauacaaaugagaaccgaccaaccaugcgucuccugugcaugcuguauacuccccucagagccgggggagcaucggcugguacagauccuuucguuauagccggcaggguguuaaccuguccaucacccgacuuuaauuuccuguuucuugucccgccuagcguggagcagaagacgcggcaauugacugugcccaacauuccacugaacaaucuaaguaacuccucugucccugcgaugaucaauaaaauggccauuagcuccgaugcaaaccagguugugcaguuccagaaugggcgcugcaccacagacggacaacuccugggcacuacccccaucucagcuagucagguagccagaaucagggguaagguguuuagcacaucuuccgggaaaggacuuaaccugucagaauuggauggcagcccauaccacgcuuucgagagucccgccccugucggcuucccagaccucgggcauugugacuggcacgugucuuccuuuaaggcagaucagaauagcucgggagacccgauuucucggcuggauauaaagcaaggugccuccuucgcuccccacuuaggcucaaucgaauauaccacgagucagaacccugacgggggacagcugggcacucucacauggauuagcuccccaucugaugacacccccggucaugggacuaucaaucuuuggaaaauaccuagcuacggcucaacaguuaccgagagugugcaccuggcgccacccauuuauccgccuggauuuggcgagacguuggucaaccuaauguccaauuucccaaucgggcauaccaacagcaauauggcacaggugcccugcacacugccucaagaauuuguagcccacuucguuaacgagcaggcucccgugcgcggagaugccgcacuccugcacuacgucgacccagauacucaucgaaaucuuggugaauuuaagcuguauccugagggcuacaucaccugugugcccaacacagggggaggcgguccacagucuuugccgacuaacggggucuucaucuuuucaaguugggugagcagauacuaucagcucgaaccuguuggcaccgccggacccgcuaggcggcugggcgugcgucgcguauga

SEQ ID NO: 19187 - RNA, 1620 nt, Artificial Sequence
  derived and/or modified sequence opt3 from capsid_protein__Norovirus__AAU95776
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaagugaucuucgcugccguaccuccaaacuuuccgacggagggccucucccccucucagguuaccauguucccucauauuaucguggacguccgccaacuggagccagugcuuauaccccugccugaugugcgaaauaacuuuuaucacuacaaucagucgaacgacucaacaaucaaguugauugcaaugcucuauacuccacugaaagcuaacaaugccggggaugacgucuucaccguuagcugccgugugcugacaagacccaguccggauuuugacuucaucuuucucguaccucccaccguggaauccaggacuaagccauucacagucccuauuuuaaccguggaggaaaugucuaacagccgguuucccaucccacuggagaaacuuuacacgggacccuccucagcguucguugugcagccucagaauggucgcuguacuaccgauggcgucuugcuggggacaacucaacuaagugccgugaacauaugcaccuucagaggagacguaacacauauugcaggcagccacgauuauaccaugaaucucgcuucucagaacuggaauaacuacgacccaacggaggaaaucccggcuccccuggguacuccugacuuuguugggaagauucagggaaugcuuacacagaccacuagggaggauggcuccacacgggcccauaaggccaccgugucaacgggcagcguccacuucaccccaaaacuggggagugugcaauacacaacugacaccaauaacgauuuucagacaggacagaauacuaaguucacccccgucggugugauccaagacggcaacaaucaccagaacgaaccucagcaguggguuuugccaaauuauucugggcgcacaggacauaacgugcaccucgcacccgccguagcuccgaccuuuccuggcgagcaacuguuauucuuucgauccacuaugccagguuguagcggguaccccaacaugaaucuggauugccuccuuccucaggaauggguccagcauuucuaucaggaggcggcacccgcccaaucggacguggcucuguugagauuuguuaacccagauacgggcagggugcuauucgaguguaaacugcacaagucuggauacgucacaguggcccacaccggcccucaugaccucguaauucccccaaauggguauuuucgguucgauuccugggugaaccaguuuuacacucuggcaccgaugggaaauggugccggccgucgcagagcucuuuga

SEQ ID NO: 19188 - RNA, 1644 nt, Artificial Sequence
  derived and/or modified sequence opt3 from capsid_protein__Norovirus__AAX32874
augaagauggccagcaacgacgcugcacccuccaccgauggcucugccgggcuggugccugaggucaauaacgaaacaauggcgcucgagccaguugugggagcuccgcuugccgcacccguagccggucagcacaauaucauugacccuuggauaaaaaugaacuucgugcaagcuccaaauggcgaauuuacugucucacccagaaacgcaccuggggagauccuguuggauuuagaacugggaccagaccuaaaucccuaccucagucaucuggccaggauguauaacggcuacgcuggugggauggaggugcagguugugcuugccggaaaugcguucacggcaggcaagauuaucuuugccgcugucccuccaaacuucccggccgagaaucugagcgcagcucaggugaccaugugcccccacguaauuguugaugugcggcaguuggaaccugucaugcucccaaugcccgacauccgcaacaaacuguuucauuauaaucaaguggaugacccuaagcugcgacucuuagccuaccuguauacaccacuucgugcgaacaaugccggcgaugacguguucacugucuccuguagaguuuugaccaggcccacaccggauuuugaguucauguuucuggugccucccaccguagaaucuaaaacuaagccauucucgcuaccuucacucacacuggacgagcuuagcaacagucgguuucccgcaccaauagugcagcuguacaccaacccccacgauaauuuggucgugcagccucagaacgggcgcugcacgaucgacggacuccugcaagguacuacccaguuaguuuccuguaaugugugcucuuucagaggcacaauuggggacggacagccagcuagccauuccgaggaagagaucaugccgauggccuuuaacauucagagggaaaucaugcuggagaaucucgauggcucacccuaugacccugcugaugacauaccagccguccuugguagucccgauuuccaagggauuguguucggaguacugagccagcggaacgcagacggccagacucgcgcccacgaagcuaagguugauacccgagcggcaagauuugccccuaaauugggcuucguggucgcuacaguggagucuaccgacuuucacgccaaucaaccauccagguucacgcccgucgggcuaggaggugauggcaaccaggacuuuaaucagugggcacugccggccuacgggggagcucucacuaacaauacaaaccuggccccuccagugaugcccguuuacccuggcgagcagauccuuuauuuccggucacaacugcccagcagugguggggugguaggcggaugguuggauugucuccugccacaggaauggguccagcacuuuuuccaggagucugcaaccucccaaagcgacguggcguuaguucguuacauuaauccuacuacaggccgcgugcuguuugaagcuaagcuacauaaacagggguuccucaccgucgccgcaucgggaucuuauccccuggugguaccagccgacgguuacuuuagauucgaguccugggugaaccaguuuuauacgcuugcuccgaugggcaaugggucaggaaggcggcgaacccgcuga

SEQ ID NO: 19189 - RNA, 1674 nt, Artificial Sequence
  derived and/or modified sequence opt3 from capsid_protein__Norovirus__AAX32877
augaugauggccagcaacgacgcuaccgcacccacagauggcgccgcggggcuggugccugaggucacuaaugaaacgauggcucucgagccaguugccggagcagcccuugcugcaccggugguaggucagcacaacgugaucgaccccuggauuagaggcaauuucguccaagccccuaacggggaauuuaccguguccccaaggaacucucccggagagguucuguugaauuuagaacugggcccugagcuaaauccauaccucgcucaucuggcccggauguauaacgguuacgcagggggaauggaggugcaggucgugcuugcgggcaaugccuucgcugccggcaagauaaucuuugcagcuguacccccuucauucccaguugaugcccugagugcgccgacaauuacuaugugcccccacgugaucgucgacgugcgccaguuggaaccugugcuccugccaaugcccgauguccgaaacaacuuuuuccauuauaaucagagcuccgacccuaaacugcgucucguugccauguuauacaccccacugagagcaaauucucccacagaugacguguuuaccguaucguguagggugcuuacucggccgucaccugauuucgaguuuacauucuugauucccccaaccgucgaaagcaagaguaaaccuuuuacgaucccccaacugacucuauccgagcucucuaacagccgcuucccagcucccauagacaugcuguauaccuccccuaaugauaacaucgugguucagccacagaacgggagaugcacacuugacggagagcugcaggguacuacccaauugcagccgucacucauuuguaguuuuaggggcgugacacugaaugaaaccagccggauguuagucgaucaggaggaagaggaagagggggaggugcagcgcccccaagcccgagcuuucaaccacgaauaccaucugcagcuccagaaucuugacggaacggacuaugauccugccggcgaccugccagcaacuuugggugcccccgauuucaucgggacaguauacggaguugugucucaaagaaccacuagggacuccgcugcgcgggcacacgaggccaagauuacaaccucagauccucguuacgcuccaaaacuaggcagcgucgaauuugugacggagaguaccgacaucguccugaacgaucagacaaaguucacucccgugggccucgcccacaaucgcgcaguugacuauaagcagugggaacugccgcauuacgccggggagcuuaccgcuaacacaaaucuggccccuccaguggcacccguauauccuggagagcaguugcucuuuuucagaucuaaccugcccuuagcggguggcacugcugccuccguccuggauugccuacucccacaagaauggauacagcacuuuuaccaggagagcuucgcaccucagucggacauugcccugcuuagguaugugaaucccgauaccgggcggguuuuguuugaagcuaaacugcaucgacaaggauacaucacaguggccggcgcagguaccucuccagucgcugugccgccuaacggguauuuccgcuuugaguccuggguaucacaguucuacacucucgcccccaugggcaguggaacgggcagaaggcggaaucaguga

SEQ ID NO: 19190 - RNA, 1674 nt, Artificial Sequence
  derived and/or modified sequence opt3 from capsid_protein__Norovirus__AAX32880
augaugauggccagcaacgacgcuaccgcacccacagauggcgccgcggggcuggugccugaggucacuaaugaaacgauggcucucgagccaguugccggagcagcccuugcugcaccggugguaggucagcacaacgugaucgaccccuggauuagaggcaauuucguccaagccccuaacggggaauuuaccguguccccaaggaacucucccggagagguucuguugaauuuagaacugggcccugagcuaaauccauaccucgcucaucuggcccggauguauaacgguuacgcagggggaauggaggugcaggucgugcuugcgggcaaugccuucgcugccggcaagauaaucuuugcagcuguacccccuucauucccaguugaugcccugagugcgccgacaauuacuaugugcccccacgugaucgucgacgugcgccaguuggaaccugugcuccugccaaugcccgauguccgaaacaacuuuuuccauuauaaucagagcuccgacccuaaacugcgucucguugccauguuauacaccccacugagagcaaauucucccacagaugacguguuuaccguaucguguagggugcuuacucggccgucaccugauuucgaguuuacauucuugauucccccaaccgucgaaagcaagaguaaaccuuuuacgaucccccaacugacucuauccgagcucucuaacagccgcuucccagcucccauagacaugcuguauaccuccccuaaugauaacaucgugguucagccacagaacgggagaugcacacuuggaggugagcugcagggcacuacccaauugcagccgucacucauuuguaguuuuaggggagugacacugaaugaaaccagccggauguuagucgaccaggaggaagaggaagagggggaggugcagcgcccccaagcccgagcuuucaaccacgaauaccaucugcagcuccagaaucuugauggcacggacuaugacccugccggugaucugccagcaacuuugggggcccccgacuucaucggaacaguauacggcguugugucucaaagaaccacuagggauuccgcugcgcgggcacacgaggccaagauuacaaccucagacccucguuacgcuccaaaacuaggcagcgucgaauuugugacggagaguaccgauaucguccugaacgaccagacaaaguucacucccguggggcucgcccacaaucgcgcaguugauuauaagcagugggaacugccgcauuacgccggagagcuuaccgcuaacacaaaucuggccccuccaguggcacccguauauccuggugagcaguugcucuuuuucagaucuaaccugcccuuagcgggcgggacugcugccuccguccuggacugccuacucccacaagaauggauacagcacuuuuaccaggagagcuucgcaccucagucggauauugcccugcuuagguaugugaaucccgacaccggacggguuuuguuugaagcuaaacugcaucgacaaggcuacaucacaguggccggugcagggaccucuccagucgcugugccgccuaacggcuauuuccgcuuugaguccuggguaucacaguucuacacucucgcccccaugggaaguggcacggggagaaggcggaaucaguga

SEQ ID NO: 19191 - RNA, 1647 nt, Artificial Sequence
  derived and/or modified sequence opt3 from capsid_protein__Norovirus__AAX32886
augaagauggccagcuccgacgcugcacccucuucagauggcagugccgggcuggugccugaggucaacagcgaaaccauggcgcucgagccaguugugggagcuccgcuugccgcacccguagccggucagcacaauaucauugacccuuggauaaaacugaacuucgugcaagcuccaaauggcgaauuuacagucucccccagaaacgcaccuggggagaucuuguuagaucuggaacuaggaccagaccucaaucccuaccuggcccaucuuucuaggauguauaacgcuuacgccggcgguauggaggugcagguuauucuggcggggaaugcauucacugccggaaagaucauuuuugcugccgugccuccaaacuucccguuggagaaucucucggcagcucagaucacgaugugcccccacauaaucgucgaugugcggcagcuggaaccuguaaugcugccaaugcccgacguucgcaaccgacucuuucauuauaaucaagugcgugagccuagauuaaggcuggucgccuaccuuuauaccccauugcgggcgaacaaugccggcgaugacguguucacagugucaugucgcguccugacuagacccagccaggauuuugaguucauguuucuaguuccgccuaguguggaauccaaaaccaagcccuucucucucccaaaccugacacuugcagagcugagcaauuccagguuuccuuugcccauugaacagcucuacaccaacccacuggacaacuuaguagugcagccccaaaauggccggugcacuaucgaugggauucugcucggaacaacccagcuugucccuucacugaucuguaguaugcgcgguacguuggaggcugaccaggccagcggccacacugaugacgaaucugugcagucccgagcuuucaacagacaaaggucacuaaugcuggagaauccagacgggagcgccuuugauccgagugacgaaguucccgcagugcucggagucccugauuuccggggcgugguauucgguguucugucucagcguaacaauggggacaccacacgcucccaugaggccaaaauagauacuagaaggccacgguaugcucccaaguugggauuuguggagguccugaccgaaagcgacgauuuccagaacggcccuccaacaaaguuuacccccgugggccuugggggagacgguaauccggauuuccaacagugggcgcucccugacuacggcggggcacugacgaacaauacuaacuuagccccacccgucgugccuguuuaccccggagagcagauucuguuuuuccgaucgcagcuaccaucuuccggcgguacaguggcuggguggcucgauugccugcuuccucaagaauggauccagcacuuuuaucaggacucagccgcagcccagagugacguagcuuugguccgcuacauuaaucccgccaccggcagagugcuguucgaggcaaaacuccacaggcaaggauuucugacuguuagcgcggcuggcccacauccgguggucgccccugcagauggguauuuccgguuugaauccugggugaaccaguucuacacacuugcccccaugggaaaugguucuggccgcagaaggguauauuga

SEQ ID NO: 19192 - RNA, 1623 nt, Artificial Sequence
  derived and/or modified sequence opt3 from capsid_protein__Norovirus__AAZ31376
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagguacucucccccucucagguuacaauguucccucauaucauaguggacguccgccaacuggagccagugcuuaucccccugccugaugugcgaaacaauuuguaucacuacaaccagucgaaugacccaacuauucgucucaucgcaaugcuguauacgccccugagagcuaacaacgccggcgaugacgucuuuacaguuucaugcagggugcucacccggccgagcccugauuucgacuuuauguucuuaguacccccaacuguggaaagucgcacaaagccuuuuuccguccccauucugaccguggaggaaaugaccaauucuagauucccaaucccccuugagaaauuguuuacugggccuagcuccgcguucguugugcagccacagaacggaagguguaccacagaugguguccugcuaggcacuacccaacucucaccggugaauauaugcacauuccgcggggacguaacccauauugccggagcacagaacuacacgaugaaucuggcuagucagaacuggaauaacuaugaucccacugaggaaaucccugccccacuuggcacacccgacuuuguugguaagauucagggggugcugacccaaacuacacggcgagacggaagcaccagaggccacaaagcuacggucucuaccggcuccgugcauuucacaccuaaguuggggucaguccaguuuagcacugauaccaguaaugacuucgagacaggacagaacacuagguuuaccccaguggguguugugcaagauggcucuacaacccaccagaaugaaccccagcaguggguacucccggacuacuccgggcgggauagccacaacguccaucuggccccugcaguggccccaacuuuccccggagagcaauuacuguuuuuccguucgacgaugccuggcuguucugguuaccccaauaugaaccucgacugccuucugccacaggaauggguucagcacuuuuaucaggaguccgcuccugcgcaaucagauguggcauugcuacgcuucgucaaucccgacacagggagagugcuguuugaguguaagcuccauaaaaguggcuacguaaccguggcccacacuggacagcacgaucugguuaucccaccgaacggcuauuucagguuugacagcuggaucaaccaguucuacacccuugcuccuauggggaauggagccggucggcgacgcgcacuguga

SEQ ID NO: 19193 - RNA, 1623 nt, Artificial Sequence
  derived and/or modified sequence opt3 from capsid_protein__Norovirus__AAZ31396
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagguacucucccccucucagguuacaauguucccucauaucauaguggacguccgccaacuggagccagugcuuaucccccugccugaugugcgaaacaauuuguaucacuacaaccagucgaaugacccaacuauucgucucaucgcaaugcuguauacgccccugagagcuaacaacgccggcgaugacgucuuuacaguuucaugcagggugcucacccggccgagcccugauuucgacuuuauuuucuuaguacccccaacuguggaaagucgcacaaagccuuuuuccguccccauccugaccguggaggaaaugaccaauucuagauucccaauaccccuugagaaauuguuuacugggccuagcuccgcguucguugugcagccacagaacggaagguguaccacagaugguguccugcuaggcacuacccaacucucaccggugaauauuugcacauuccgcggggacguaacccauaucgccggaacgcagaacuacacuaugaaucuggcaagucagaacuggaauaacuaugaucccacagaggaaauuccugcuccacuuggcacccccgacuuuguuggucggauccagggggugcugacucaaacaacccgaagagacggaagcacgaggggccacaaggccaccgucucuacaggcuccgugcauuucacuccuaaauuggggucaguccaguuuagcaccgauacaaguaaugacuucgagacuggacagaacacccgguuuacaccaguggguguugugcaagauggcucuaccacucaccagaaugaaccccagcaguggguacucccggacuacuccgggcgugauagccacaacguccaucuggcuccugccguggcaccaacguuccccggagagcaauuacuguuuuuccgcucgacaaugccuggcuguucugguuaccccaauaugaaccucgacugccuucugccacaggaauggguucagcacuuuuaucaggaguccgccccugcucaaucagauguggcguugcuaagauucgucaaucccgacaccgggagggugcuguuugaguguaagcuccauaagaguggcuacguaacuguggcacacaccggacagcacgaucugguuaucccaccgaacggcuauuuccgguuugacagcugggucaaccaguucuacacacuugccccuauggggaauggagcuggucgacgcagagcccuguga

SEQ ID NO: 19194 - RNA, 1623 nt, Artificial Sequence
  derived and/or modified sequence opt3 from capsid_protein__Norovirus__AAZ31402
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucgggcccucucagguaaccauguucccucauaucauaguugacgugcgccaacuggagccaguccuuaucccccuguuggaugugcgaaacaaucucuaucacuacaaccagucgaaugacccuacaauuaagcugaucgcaaugcuguauacuccacuccgugcuaacaacgccggagaaguggucuuuaccguuucaugcagaguguuaacaaggcccagcccggauuucgacuuuauuuuccugguaccucccaccguggagagucggacuaaaccauuuacagucccuauccuuaccgcggaagagaugacuaauucccgcuuccccacgccauuggguaagcuguuuaccggccccucuagcgccuucgugguucagccucagaacgggagaugugcaacagauggagugcuacucggcacuacccaacuguccccagucaauauaugcacauucaggggugacgugacccauauugcugggacgcacgauuacacuaugaaccuugccucacagaauuggaacaauuaugacccgacagaggaaauccccgcuccucugggaaccccagauuuuguaggcaaaauucagggcguuuugacucagacaacccgcggggacggaaguacgcggggucauaaggccaccgugagcacaggcucuguccacuucacucccaagcucgggggagugcaauuuaccacagacacuaacaaugauuucgagaccggccagaacacaaaauuuaccccugucggugugauccaggacggcaauuccacucaccaaaacgaaccacagcaguggguucugcccaauuacucagggcgaacgggacauaacgugcacuuagcaccggccguagcuccuacauucccaggcgagcagcugcucuuuuucagaagcaccaugcccggguguaguggauacccuaauaugaaccuugauugccuguugccccaagaauggguccagcauuuuuaucaggaggcggcaccagcccagucugacguggcucuacugagguucguuaacccugaugccggucgggugcucuuugaguguaagccccacaaauccggcuacgucacuguggcacacaccgggcaacaugaccugguaaucccaccgaauggauauuuccguuuugauagcugggugaaccaguucugcacacuugccccuaugggcaaugguaccgggcgcagaagggcucuguga

SEQ ID NO: 19195 - RNA, 1620 nt, Artificial Sequence
  derived and/or modified sequence opt3 from capsid_protein__Norovirus__AAZ31411
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacccuagccacuuagcccggauguauaacggcuacgcggguggguucgaagugcaggucauucuggcaggaaaugccuuuacagcuggcaaaaucauuuucgccgcagugccaccgaacuuucccacugagggccuauccccuucucagguaacgauguucccacauaucauaguugacgugcgccaacucgaucccguccugaucccuucgccagacgugcgaaauaacuuuuaucacuacaaucagucaaacgauagcaccauuaaguugaucgcuaugcuguauacacccuugcgugccaacaaugcgggggacgauguguucacugucaguugcagaguucucaccaggccguccccugacuuugauuucauuuuucuggugcccccaacaguagagucucggaccaaaccuuucacugugcccauccugacagucgaagagaugagcaacucccgcuuuccaauaccccucgaaaaguuauacaccggaccuucaagugccuucgugguucagccacagaaugguagauguacgacugacggcgugcugcuugggaccacacaauugagcgcagucaacauuugcacuuucaggggagaugugacccauaucgcuggcucucacgacuauacaaugaaucuggccucccagaacuggauuaauuacgacccgaccgaggagauccccgcuccucuagguacgccagauuuuguagggaaaauccagggaaugcucacucagacaacccgggaagacggcucaacucgcgcccauaaggcaacaguuagcaccggcagugugcacuucacgcccaagcuggggucuguccaauacaccacagauacuaacaaugacuuucagaccggacaggauacaaaauucacuccugugggugucauucaagacggcaacaaucaccagaacgagccacagcagugggugcuucccaauuauuccgggcgaaccggacauaacguucaccuggccccggcuguggcgccuacauuuccaggcgaacaacuucucuucuuuagaagcaccaugcccgguuguucgggguacccuaauaugaaccuggauugcuuacugccccaggaguggguacagcauuucuaucaggaagcagccccagcucaaccugacgucgcccuccuuagguuugugaaccccgauacuggccggguucuguucgaguguaaguugcacaaaucuggauacgugacggucgcacacacaggcccacaugaccuagugauaccgccuaauggguauuuucguuucgauuccuggguaaaccaguuuuacacccuggcccccaugggaaauggugcuggccgcagaagggcccucuga

SEQ ID NO: 19196 - RNA, 1647 nt, Artificial Sequence
  derived and/or modified sequence opt3 from capsid_protein__Norovirus__AAZ31423
augaagauggccagcuccgacgcuacccccucuaacgauggcgcagccgggcuggugccugagaucgacaaugaagcgauggcucucgauccagucgccggagcagccauugcugcaccgcuuacaggucagcaaaacauaaucgaccuguggauuaugaauaacuucguucaggcccccggcggggaguuuacugugucaccuagaaauaguccaggagaaguauuguuaaaccuggagcuaggccccgaaaucaauccuuaccucgcucaccuggccaggaugcauaacgguuaugcagggggauucgaggugcaggucgugcuugcaggcaaugccuuuacggcuggcaaaauuaucuucgccgcaauaccacccaacuuuccuaucgauaaucugagcgcugcccagauuaccaugugcccacacguuaucguggacguccggcaauuggagccggugaaccuccccaugccugauguacgcaauaacuucuuucauuacaaucagggguccgacucucgacugcgucugauugcgaugcucuauacaccauuaagagccaacaacucgggagaugacguuuucacugugucauguaggguccugacccggcccagcccugauuuuaguuucaauuuucuugugccacccacaguggaauccaagaccaaaccguucacuuugccuauccugacaauaucugagaugagcaacucccgcuuucccgucccaauugacucacuacucaccaguccuacggaaaauaucguugugcagugccagaacgguagaguaacucuggauggcgagcuuauggggaccacacaacuguugcccagccagauuugugcauucaggggagugcucacucggucuaccucccgcgcuucagaccaggccgacacagcuaccccacgacuguucaauuacuauuggcacauccaguuagauaaccugaauggcacgcccuacgacccugccgaggauaucccagguccgcucgggacucccgacuuuagaggaaaggucuucggcguggcaagccaaaggaacccugauaguacaacccgggcccaugaagcuaaaguugacacuacagcgggccguuuuaccccaaaacuugggucucuggagauuuccacggaaagcgaugacuucgaucagaaucagcccacccgcuuuacaccugugggaauaggugucgacagagaggcagauuuccaacaguggucguugccagacuauucuggccaguuuacucacaacaugaaucuagcccccgcuguggccccgaaccugccuggggaacagcuccuguucuuuaggucccaacuuccaucaaguggaggccggagcaccgguauccuggacugcuugguaccccaggaguggguucagcacuucuaccaggaguccgcgccugcccaaacacagguggcucucguccgauacauuaaucccgauacugggcgcgugcuguuugaagccaaguuacauaagcugggcuucaugaccaucgcaaagaacggagacucuccaauaacagucccucccaauggcuauuuuagauucgagagcugggugaacccauucuacacccuagcgccgauggggacuggaucagguaggcggcgcauucaguga

SEQ ID NO: 19197 - RNA, 1623 nt, Artificial Sequence
  derived and/or modified sequence opt3 from capsid_protein__Norovirus__AAZ31428
augaagauggccagcaacgacgcugcacccuccaaugauggcgccgcggggcuggugccugagaucaacaaugaagucaugccacucgagccgguugcuggagccucucuugcaacccccgugguaggucagcaaaacauuauagacccuuggaucagaaauaacuucgugcaggccccagcuggcgaauuuacagucucacccaggaauaguccuggggagauucuguuggauuuagaacugggaccagagcuaaaccccuaccucgcacaccuggcccggauguauaauggccauccuagcgguauggaggaacagaucgugcuugcugggaacgccuucacugcgggaaaaauuaucuuugcagccauaccaccgggcuuccccuacgagaaucuguccccuucucacaugacgaugugcccacauguuaucauuuaugugauccaguuggaacccguccucaugcugaugccugagauucaaaacaacuuuuuccacuacaaucagggcaaugacccaaagcugcgccucguggcuauguuauauacaccccugcgagccaacaacucgggggaugacguauuuaccguuucaugucgugugcuuacuaaaccgagcccugauuucgaguuuaccuucuuggugcccccaacagucgaaaguaagaccaaagaguuuacucugccuauccuaagaauauccgaaaugacaaauucuagguuccccgugccagucgagaugauguacaccgcacggaacgaaaaucagguugugcagccccaaaacggacgcguaacgcucgacggugagcugcuuggcacuaccccucuguuggcugugaauauuugcaaguuuaagggggaggucaucgccaaaaacggagaugugagaagcuauaggauggacauggaaauuacaaauacugauggcaccccaaucgacccgacagaggauacccccgguccuaucggguccccagacuuccagggcauucucuucggaguugcgucacagcggaacaagaaugaacagaaccccgccacgcgcgcacaugaggugaauauaaacacuggcggggaccaauacgcuccuaaacuggcccaggucaaguuuuucagugaaagccaggauuuugaggugcaccaaccaacaguauucacccccguuggaguggcuggugacacuucucacccguuucgacagugggucuuaccuagauacggcgggcaucugacaaauaacacccaccucgccccagcaguggcuccccuuuucccuggagagcagauccuguuuuucaggucccagauucccucaagcggcggucaugaauugggguauauggauugucuagucccacaagagugggugcagcacuuuuaccaggaagccgcgacggcacagagugagguugcccugauccgguucauaaauccugacaccggccgugugcucuuugaagcuaaacugcacaagcaaggauucauuacaguagcccauacuggcgauaaccccaucgucaugccaccgaacggguauuuucgcuucgaggcaugggugaaucaguucuacucucuugccccuguuggaaccgguaacggcagaaggcgggugcaguga

SEQ ID NO: 19198 - RNA, 1626 nt, Artificial Sequence
  derived and/or modified sequence opt3 from capsid_protein__Norovirus__ABB02420
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguacuucagcccagacugugcacgcaugcaagguggccagcuccuguguacggcuugcucgucgaccccucccugccaucuaauccccaauggcagaacgggcgggugcacguugauggaacuuuacugggcaccacaccugugagcgguuccugggucucauguuucgccgcugaagccgcauaugaguuucagagugggacuggacaaguggccaccuucacaaugauugagcaggacggcagcgcuuacguaccaggcgaucgcgcggcaccgcucggguaccccgacuauucuggacagcuugaaaucgagguucagaccgaaacgacuaaggccggugacaaacugaaggugacaaccuuugagaugauuuugggcccuacuacaaaugucgaucaagcuccauaccaggggcgagccuaugcaucccuaaccgccguggcuucacuggaccucgucgauggaagagugagggccguuccccggagcaucuacaguuuccaggacgugcugccugaauauaacgauggccuucugguaccauuggcacccccgcucgguccuuuccugccaggggaggucuuacugcguuuucgcacguacaugagacagcuagacaccgcggaugcugccgcacaacccauagacugcgcccucccucaggaguucauuucuugguuugcuuccaauagcuucacagugcagucggaugcccugcuuguuagguaucggaacacuuugaccggccagcugcucuuugaagcaaagcuguacucugagggauacaucgcuguguccuauucaggcagugggccccuuacauucccaacugacggauuuuucgaagucgugagcuggguaccucgacuguuucaauuggccuccguggguucucucgcgaccggccgcacacugaaacaguga

SEQ ID NO: 19199 - RNA, 1626 nt, Artificial Sequence
  derived and/or modified sequence opt3 from capsid_protein__Norovirus__ABB02423
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcguccgacuucaacuuuguuuaccucacacccccgauagagcggaccaucuaucgcaugguggaucugccuguacuucagcccagacugugcacgcaugccagguggccagcaccuguguacggcuugcucgucgaccccucucugccaagcaauccccaauggcagaacgggcgggugcacguugauggaacuuuacugggcaccacaccuguguccgguucaugggucaguuguuucgcugccgaagcugccuaugaguuucagagcgggacuggagagguggcaaccuucacaaugauugaacaagacggcucugccuacguaccaggcgaucgcgcugcgccgcucggguaccccgacuuuuccggacagcuugagaucgaaguucagaccgagacgacuaagacaggugacaaacugaaggugaccacuuucgaaaugauuuugggcccuacaaccaaugucgaucaggcaccauaucaagggcgagccuacgcuucacuaacggccgcagccagccuggaccucguggauggaagagucagggcugugccccggaguguuuauucuuuccaggacgagcugccugaguacaacgauggccuucuggugccauuggcacccccgcucgguccuuuucugccaggggaaguauuacugcguuuccgcaccuauaugagacagcuagacacagccgaugcguccgcucagcccaucgacugcgcccucccucaagaguuuauaagcugguucgcaucgaauaacuuuacuguccagucugaugcccugcuugugagguaccggaauaccuugacaggccagcuccuguucgaagcuaagcuguauuccgagggauacauugccguuucauacaguggcagcgggccccuuacuuuuccaaccgacggauucuuugaaguggucuccugggugccucgacuguuccaguuggcaucuguagguagccucgugacaggccgcacccugaaacaauga

SEQ ID NO: 19200 - RNA, 1623 nt, Artificial Sequence
  derived and/or modified sequence opt3 from capsid_protein__Norovirus__ABC96746
augaagauggccagcaacgacgcuuccucuucagauggcaguaccgcaaaucuggugcccgaggucaacaaugaaguuauggcccucgagccugugguaggggcggcuaucgccgcaccaguggccggacagcaaaacgucaucgacccguggauaagaaauaacuucgugcaggcucccgguggcgaauuuacaguuagcccuaggaaugcaccaggggagauccuuugguccgcuccccugggaccugauuugaacccauacuuaucucaccuggcccggauguauaauggcuacgccgguggguucgaagugcaggucauucuagcgggaaacgcauuuacugccggcaaaaucauuuucgcugccgugcccccuaauuuuccaacggagggccucucgccgucacagguaaccauguucccccauaucauaguugacgugcgccaacuggagccuguccuuaucccacugcccgaugugcgaaacaauuuuuaucacuacaaccagagcaaugacccuacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucgccggcacgcacgauuacacuaugaaccucgcaagccagaauuggaacaauuaugacccgacagaggaaauucccgcuccucuggguaccccagacuucguagggaagauccagggaguucuuacucagacaacccggggcgauggcucuacgcgcgggcauaaggccaccguguccacaggaucaguccacuuuacucccaagcuggguagcgugcaauucaccacagacacuaacaaugauuuugagaccggccagaacacaaaauucaccccugucggggugguucaggacggaaauaguacucaccaaaacgaaccacagcaguggguguugcccaauuacucuggccgaacgggucauaacguacaccucgcuccggccgucgcaccuacauuuccaggggagcagcuguuauucuuuagauccaccaugcccggcuguagcggauacccuaauaugaaccuggauugccuccuuccccaagaaugggugcagcauuucuaucaggaggccgcuccagcgcagucggacguugcacuguugagguuugugaacccugauacuggccggguccuauucgaguguaagcugcacaaaucuggguacgugaccguagcccacacaggacaacaugaccucgugauucccccaaaugguuauuuucguuucgauuccuggguuaaccaguucuacacccuggcuccgaugggcaauggggccggacgcagaagggcacuuuga

SEQ ID NO: 19201 - RNA, 1620 nt, Artificial Sequence
  derived and/or modified sequence opt3 from capsid_protein__Norovirus__ABD77588
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaguagcgugcaggcuccugguggcgaguucacaguuuccccaagggaugcacccggggaaauccuuuggucugccccucugggaccagacuugaaccccuacuuaucgcaccuggcucggauguauaauggcuacgccgguggguuugaagugcaggucauucuagcgggaaacgcauucacugccggcaaaaucauuuuugcugccgcaccuccaaauuucccgacggagggccucucacccagccaggugaccauguuuccucauaucauaguagggguucgccaacuggagccagugcuuaucccccugccugauguccgaaacaauuucuaucacuacaaccagaguaaugacuccacaauuaaguugaucgcuaugcucuauacuccacugcgugccaacaaugcgggagaugacguguuuaccgugucuugcagaguccugacaaggcccagcccggauuucgacuuuauuuuccucguuccucccaccguggaaucccggacuaaaccauuuacaguaccuaucuuaaccguggaggaaaugacgaacucacgcuuccccauaccacuggagaacuguaguagaguccccgccgugccucuuagcucuaaucauaagaugcagugcacuaccgaugguguuuugcugggcacaacucagcuauccccagugaacauuuguaccuuuaggggagacgucacacacaucccggggacccggacguaccgcaugaaucucgcaucacaaaacuggaauaacuaugaucccacugaggaaauuccugcuccacugggcacacccgacuucguggguaaaauccaggggaugcuuacccagacuacaaagggagacggcagcacccgaggccauaaggccacgguaaguaccgggucuguugauuucacaccuaaacugggauccgugcaguuugcuacugacaccgauaaugacuucgagacaggucaaaacacuagauuuaccccagucggcgugauccaggaugggagcucgacacacaggaaugaaccccagcaaugggucuugccggacuacucuggacggaccgugcacaacguucaucucgccccugcaguggccccaacuuuccccggcgagcagcuguuauuuuuccguuccacgaugccugguugcucaggguaccccaauauggaucuggacugucuccuuccacaggaauggguacagcacuuuuaucaagaggcugcgccuagucagagcgaugucgcacuguugcgcuucgugaaccccgacacaggcagaguucuauuugagugcaagcugcauaaagccggauacgugaccgucgcucacacuggccagcacgaucucgugauuccaccgaauggguauuucagguuugacuccuggguaaaccaguucuacacccuggccccuaugggaaauggugcaggccggcgacgcgcccuuuga

SEQ ID NO: 19202 - RNA, 1623 nt, Artificial Sequence
  derived and/or modified sequence opt3 from capsid_protein__Norovirus__ABD77589
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcgagggcacaaggcuaccguuuccacaggaucaguggauuuuacuccuaaacuggacagcguccaauucgccaccgauacagacaacgauuuugagacuggucagaauaccagauucacaccagugggcgucauccaggacgggaguucugcucauaggaacgaaccccaacaguggguguugccggauuacuccggacggaccguucacaaugugcaccucgccccugcaguagccccaacuuuucccggcgagcagcuguuauucuuucguagcacgaugccugguuguucgggguaccccaacauggaccuggauugccuccuuccacaggaauggguccaacauuucuaucaggaggcugcgccuucucaguccgacguggcacuguugcgcuuuguuaaucccgauacaggcagagugcuauucgaguguaagcugcacaaagccggauacgucaccguggcucauacuggccagcacgaccucguaauuccaccgaacggguauuuuagguucgacucaugggugaaucaauucuacacccuggccccuaugggaaacggugcaggccggcgacgcgcccuuuga

SEQ ID NO: 19203 - RNA, 1647 nt, Artificial Sequence
  derived and/or modified sequence opt3 from capsid_protein__Norovirus__ABD77590
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauuccaagcuccgacugguugcgaugcuguacacaccccuccgugccaauaacucuggagacgauguguucacugucucguguagaguguuaaccaggccuucaccagacuuuagcuucaauuuucuggugcccccgacagucgaaaguaaaaccaagccuuucacucuucccauuuugacaaucuccgagaugucuaacagccgguuuccaguuccuauagauucccugcauaccucacccacggaaaauauuagugugcagugccagaacggucgcguaacucuagacggcgagcucauggggaccacacaacugcuuccaagccagaucugugcauucagaggagugcugacuaggucuaccucccgggcuucagaucaggccgacacagcuacgccccgcuuguucaauuauuacuggcacauucagcucgacaaccugaauggcaccccuuaugauccagccgaggacaucccgggucccuuagggacuccugauuuucgaggaaaagucuucggcguggcaagccaaagaaacccagacaguacaaccagggcccaugaagcuaagguugauacuacagcgggccgguuuacccccaagcuggggucucucgagaucuccacggaaagcggagacuucgaucagaaucagccuacccguuuuacaccaguggguauuggcgucgaccacgaggaaaacuuccaacaguggucgcuucccgauuacucugggcaguuuacucacaauaugaaccuggcaccggccguggcuccuaauuucccaggagagcaguugcuauuuuuccgcucccaacugcccucaaguggcgguagaagcaacgggauacucgacugccugguaccucaggaguggguucagcauuuuuaccaggaauccgcccccgcacaaacccagguggcccuugucagguaugugaacccagauacaggccggguccuguucgaggcuaaauugcacaagcucggauuuaugacuaucgccaaaaauggcgacucuccuauuaccgugcccccaaacggguacuuccgauucgaaagcuggguuaauccguuuuauacacuggcaccuaugggaaccgguaacggccgcagaaggauccaguga

SEQ ID NO: 19204 - RNA, 1626 nt, Artificial Sequence
  derived and/or modified sequence opt3 from capsid_protein__Norovirus__ABG45845
augagaaugagcgacggcgccgcucccaaggcaaacggguccgaggccucuggacaggaucuggugccuaccgcggucgaacaagcuguuccaauccagccgguggccggugcaucacucgccgcucccgcagccggccagauuaaucagauagacccuuggaucuuccaaaacuuuguacagugcccacuuggggaguucaguauuagccccaggaauacaccuggagaaauccuguuugauuuggcuuuaggcccaggucugaaccccuaccuagcccaccucuccgcgauguauacugggugggugggaaauauggagguccagcuggugcuugcaggcaacgccuucacggcuggcaaaguuguggucgcccuggugccuccauacuuuccgaaggggucuuugaccacagcacagauuacuuguuucccccauguaaugugcgacguucggacccucgaaccuauccaacugccacugcucgaugugcgccgagucuuauggcacgcuacacaggaccaggaggagucgaugcgucugguguguaugcuuuauacccccuugagaacuaauucaccuggagaugagagcuuuguggucagugguaggcugcuauccaaaccagccgcggacuucaacuuuguuuaccucacacccccgauagaacggaccaucuaucgcaugguggaucugccuguacuucagcccagacugugcacgcaugccagguggccagcaccuauuuacggcuugcucguggaccccucucugccagcuaauccccaauggcagaacgggcggguccacguggauggaacuuuacugggcaccacaccuguuagcgguuccugggugucauguuucgccgcugaagccgcauaugaguuucagagugggacuggagaggucgccaccuucacacucaucgaacaagacggcagcgcuuacgugccaggcgaucgcgcggcaccgcuuggguaccccgacuuuucuggacagcuggagauugaaguacagaccgagacgacuaagacaggugacaaauugaccguuacuacauucgaaaugauccuaggcccuaccacgaauguggaucaggccccauuccaagggcgagcuuaugccucccugaccgcagccgcuucacucgaccuggucgauggaagagugagggccgucccccggagcauauacaguuuucaggacgugauuccugaguauaacgauggccuucugguuccauuggcacccccgaucgguccuuuccucccaggggaggugcuguuacguuuucgcacauacaugagacagauugacucuuccgaugcggcugccgaagcaaucgacugcgcccugccccaggaguucaucagcugguuugcuucgaaugccuucacuguacaaucugaagcacuacuccugagguaucggaacacccuuacaggccaguugcuguuugaguguaagcucuacuccgaaggauauauugcucugucauacaguggcagcgggccucuuacuuuccccaccgauggauuuuucgaggucguguccuggguuccacgacuguaccaguuggccucuguggguagccucgcgacaggccgcacccugaagcaguga

SEQ ID NO: 19205 - RNA, 1626 nt, Artificial Sequence
  derived and/or modified sequence opt3 from capsid_protein__Norovirus__ABG45847
augagaaugagcgacggcgccgcucccaaggcaaacggguccgaggccucuggacaggaucuggugccuaccgcgcucgaacaagcugucccaauccagccgguugccggugcaucacuugccgcucccgcagccggccagauuaaucagauagacccuuggaucuuccaaaacuuugugcagugcccacugggggaguucaguauuagccccaggaauacaccuggagaaaucuuguuugauuuagcucugggcccaggucuaaaccccuaccucgcccaccuguccgcgauguauacuggguggguaggaaauauggaggugcagcuuguccuggcaggcaacgccuucacggcuggcaaagugguuguggccuuggucccuccauacuuuccgaaggggucucucaccacagcacagauuacuuguuucccccaugugaugugcgacguacggacccuggaaccuauccaacugccacucuuagauguucgccgagugcuguggcacgcuacacaggaccaggaggagucgaugcgucuugucuguauguuguauacuccccugagaaccaauucaccuggagaugagagcuuuguggugagugguaggcuacucuccaaaccagccgcggacuucaacuuugucuaccugacacccccgauagaacggaccaucuaucgcaugguugaucuuccugugcugcagcccagauugugcacgcaugccagguggccagcaccuauuuacggccuccugguagaccccucuuuaccagcuaauccccaauggcagaacgggcgggugcacgucgauggaacucugcucggcaccacaccugugagcgguuccuggguuucauguuucgccgcugaagccgcauaugaguuucagagugggacuggagagguggccgcuuucacccuuaucgaacaagacggcagcgcguacgucccaggcgaucgcgcagccccgcugggguaccccgacuuuucuggacaguuggagauugaagugcagacagagaccacgaagacuggugacaaacuaacaguaaccacuuucgaaaugauccugggcccuacaaccaauguugaucaggcuccauuccaagggcgaguguaugccucccucacggcagccgcuucacuggaccuugucgauggaagagugagggccgucccccggagcauauacggcuuucaggacgugauuccugaguauaacgauggucuguugguuccacucgcacccccgaucgggccuuuccugccaggcgagguguuacugcguuuucgcaccuacaugagacagauugacaguucugaugcggcugccgaagcaaucgacugcgcccuaccccaggaguucaucuccugguuugcuagcaaugccuucacaguacaaucggaagcacuccugcuuagguaucggaacacuuugaccggacagcugcucuuugaguguaagcuguacucugaaggcuauauugcucuuuccuacucagggaguggaccucugacauuccccacugauggcuuuuucgaggucgugagcuggguuccacgauuguaccagcucgccuccguggguucucuggcgaccgggcgcacauuaaagcaguga

SEQ ID NO: 19206 - RNA, 1626 nt, Artificial Sequence
  derived and/or modified sequence opt3 from capsid_protein__Norovirus__ABG45849
augagaaugagcgacggcgccgcucccaaggcaaacggguccgaggccucuggacaggaucuggugccuaccgcggucgaacaagcuguuccaauccagccgguggccggugcaucacucgccgcucccgcagccggccagauuaaucagauagacccuuggaucuuccaaaacuuuguacagugcccacuuggggaguucaguauuagccccaggaauacaccuggagaaauccuguuugauuuggcuuuaggcccaggucugaaccccuaccuagcccaccucuccgcgauguauacugggugggugggaaauauggagguccagcuggugcuugcaggcaacgccuucacggcuggcaaaguuguggucgcccuggugccuccauacuuuccgcgggggucuuugaccacagcacagauuacuuguuucccccauguaaugugcgacguucgcacccucgaaccuauccaacugccacugcucgaugugcgacgugucuuauggcacgcuacacaggaccaggaggagucgaugagacugguguguaugcuuuauacccccuugaggacuaauucaccuggagaugagagcuuuguggucaguggucggcugcuauccaagccagccgcggacuucaacuuuguuuaccucacacccccgauagaacgcaccaucuauagaaugguggaucugccuguacuucagcccaggcugugcacgcaugcccgguggccagcaccuauuuacggcuugcucguggggcccucucugccagcuaauccccaauggcagaacggacgcguccacguggacggcacuuuacuggguaccacaccuguuagcggguccugggugucauguuucgccgcugaagccgcauaugaguuucagaguggaacuggcgaggucgccgcuuucacccucaucgaacaagauggcagcgcguacgugccaggggaccgagcagccccgcuuggauaccccgauuuuucuggucagcuggagauugaaguacagacagagaccacgaaaacuggcgacaaguugacaguuaccacuuucgaaaugauccuagggccuacaaccaauguggaccaggcuccauuccaaggaagagucuaugccucccugacggcagccgcuucacucgaucugguggacggcaggguccgggccgugccccguagcauauacgguuuucaggauguuauuccugaguauaacgacgggcuucuggugccauuggcacccccgaucggcccuuuccucccaggagagguacuguuacgcuuuagaaccuacaugaggcagauugauaguucugacgcggcugccgaagcaaucgauugcgcccugccccaggaguucaucuccugguuugcuagcaaugccuucacaguccaaucggaagcacuacuccugcgguaucgaaacacucuuaccgagcaguugcuguuugaauguaaacucuacucugagggcuauauugcucuguccuacucagggaguggaccucuuacauuccccacugacggcuuuuucgaggccgugagcuggguuccacgccuguaccaguuggcguccguggguucucucgccaccgggagaacacugaagcaguga

SEQ ID NO: 19207 - RNA, 1626 nt, Artificial Sequence
  derived and/or modified sequence opt3 from capsid_protein__Norovirus__ABG45851
augagaaugagcgacggcgccgcucccaaggcaaacggguccgaggccucuggacaggaucuggugccuaccgcggucgaacaagcuguuccaauccagccgguggccggugcaucacucgccgcucccgcagccggccagauuaaucagauagacccuuggaucuuccaaaacuuuguacagugcccacuuggggaguucaguauuagccccaggaauacaccuggagaaauccuguuugauuuggcuuuaggcccaggucugaaccccuaccuagcccaccucuccgcgauguauacugggugggugggaaauauggagguccagcuggugcuugcaggcaacgccuucacggcuggcaaaguugccguggcacuggucccuccauacuuuccgaaggggucuuugaccacagcucagauuacuuguuucccccaugugaugugcgacguacggacccucgaaccuauccaacugccacugcucgauguucgccgaguguuauggcacgccacacaggaccaggaggagucgaugcgucuggucuguaugcuuuauacccccuugagaacuaauucaccuggagaugagagcuuuguggugagugguaggcugcuauccaaaccagcggccgacuucaacuuugucuaccucacacccccgauagaacggaccaucuaucgcaugguugaucugccugugcuucagcccagacugugcacgcaugcaagguggccagcuccuauuuacggcuugcucguagaccccucucugccagccaauccccaauggcagaacgggcgggugcacgucgauggaacuuuacugggcaccacaccugugagcgguucccgcguuucauguuucgcugccgaagcagccuaugaguuucagagugggacuggagagguggcuaccuucacacucaucgaacaagacggcagcgcguacgucccaggcgaucgagcagccccgcuuggguaccccgacuuuucuggacagcuggagauugaagugcagaccgagacgacuaagacaggugacaaauugaccguaacuacauucgaaaugauccuaggcccuaccacgaauguugaucaggcuccauuccaagggagagccuaugcaucccugaccgccgcugccucacucgaccugguggauggaaggguccgggcagugccccguagcauauacaguuuucaggacgucauuccugaguauaacgauggccuucuggugccauuggcgcccccgaucgguccuuuccucccaggggagguucuguuacgcuuuagaacauacaugaggcagauugacucuuccgaugcugccgcagaagccaucgacugcgcucugccccaggaguucaucagcugguuugccucgaaugcauucacugugcaaucugaagcucuacuccugcgguaucgaaacacccuuacaggccaguugcuguuugaguguaagcucuacuccgaaggauauauugcccugucauacaguggcagcgggccucuuacuuuccccaccgauggauuuuucgagguagucuccugggugccacgccuguaccaguuggcgucuguugguagccucgccacaggcagaacccugaagcaguga

SEQ ID NO: 19208 - RNA, 1626 nt, Artificial Sequence
  derived and/or modified sequence opt3 from capsid_protein__Norovirus__ABI95835
augagaaugagcgacggcgccgcucccaaggcaaacggguccgaggccucuggacaggaucuggugccuaccgcggucgaacaagcuguuccaauccagccgguggccggugcaucacucgccgcucccgcagccggccagauuaaucagauagacccuuggaucuuccaaaacuuuguacagugcccacuuggggaguucaguauuagccccaggaauacaccuggagaaauccuguuugauuuggcuuuaggcccaggucugaaccccuaccuagcccaccucuccgcgauguauacugggugggugggaaauauggagguccagcuggugcuugcaggcaacgccuucacggcuggcaaaguuguggucgcccuggugccuccauacuuuccgaaggggucuuugaccacagcacagauuacuuguuucccccauguaaugugcgacguucggacccucgaaccuauccaacugccacugcucgaugugcgccgagucuuauggcacgcuacacaggaccaggaggagucgaugcgucugguguguaugcuuuauacccccuugagaacuaauucaccuggagaugagagcuuuguggucagugguaggcugcuauccaaaccagccgcggacuucaacuuuguuuaccucacacccccgauagaacggaccaucuaucgcaugguggaucugccuguacuucagcccagacugugcacgcaugccagguggccagcaccuauuuacggcuugcucguggaccccucucugccagcuaauccccaauggcagaacgggcggguccacguggauggaacuuuacugggcaccacaccuguuagcgguuccugggugucauguuucgccgcugaagccgcauaugaguuucagagugggacuggagaggucgccaccuucacacucaucgaacaagacggcagcgcuuacgugccaggcgaucgcgcggcaccgcuuggguaccccgacuuuucuggacagcuggagauugaaguacagaccgagacgacuaagacaggugacaaauugaccguuacuacauucgaaaugauccuaggcccuaccacgaauguggaucaggccccauuccaagggcgagcuuaugccucccugaccgcagccgcuucacucgaccuggucgauggaagagugagggccgucccccggagcauauacaguuuucaggacgugauuccugaguauaacgauggccuucugguuccauuggcacccccgaucgguccuuuccucccaggggaggugcuguuacguuuucgcacauacaugagacagauugacucuuccgaugcggcugccgaagcaaucgacugcgcccugccccaggaguucaucagcugguuugcuucgaaugccuucacuguacaaucugaagcacuacuccugagguaucggaacacccuuacaggccaguugcuguuugaguguaagcucuacuccgaaggauauauugcucugucauacaguggcagcgggccucuuauauuccccacugauggauuuuucgaggucguguccuggguuccacgacuguaccaguuggccucuguggguagccucgcgaccggccgcacacugaagcaguga

SEQ ID NO: 19209 - RNA, 1620 nt, Artificial Sequence
  derived and/or modified sequence opt3 from capsid_protein__Norovirus__ABI97981
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggacuuauaacggcuacgccgguggguucgaagugcaggucauucuagcgggaaaugcauuuacggccggcaaaaucauuuucgcugccgugccuccaaacuuuccgaccgagggccucucccccucucagguaacaauguucccucauaucauaguugacgugcgccaacuggagccaguccuuaucccccugccugaugugcgaaauaacuuuuaucacuacaaucagucgaacgacucaacuauuaaguugaucgcaaugcucuauaccccacugcgugcuaacaaugccggggaugacguguucacagucagcugcagaguucugaccaggcccaguccggauuuugacuucauuuuucucgugccucccacuguagaaucccggacaaaaccauucaccgugccuaucuuaacggucgaggaaaugucuaacagccgcuuucccauaccacuggagaaacuuuacacuggacccuccucagcguucgugguucagccucagaaugguagauguaccacagauggcguguugcuggggacuacccaacuaagugccgucaacauuugcacauucaggggagacgugacccauaucgcaggcagccacgauuauacgaugaaucucgcuucucagaacuggaauaacuacgacccaacugaggaaauuccggcuccccuggguacaccugacuuuguagggaagauccagggaaugcuuacccagacuacacgggaggauggcuccacccgcgcccauaaggccacgguuucaaccggcagcgugcacuucacaccaaagcuggggaguguccaauacacuaccgacacaaauaacgauuuucagacuggacagaauaccaaauucacacccgugggugucauccaagacggcaacaaucaccagaacgaaccucagcaguggguguugccaaauuauucugggcgaaccggacauaacguucaccucgcacccgccguggcuccgacuuuuccuggcgagcaacuguuauucuuuagauccacgaugccagguuguagcggguaccccaacaugaaucuggauugccuccuuccucaggaauggguacagcauuucuaucaggaggcggcacccgcccaaucggacgucgcucuguugagguuugugaacccagauacaggccggguucuauucgaguguaagcugcacaaaucuggauacgugaccgucgcccacacuggcccucaugaccucgugauucccccaaauggguauuuucguuucgauuccuggguaaaccaguuuuacacccuggcaccgaugggaaauggugccggccgcagaagggcucuuuga

SEQ ID NO: 19210 - RNA, 1626 nt, Artificial Sequence
  derived and/or modified sequence opt3 from capsid_protein__Norovirus__ABP99038
augagaaugagcgacggcgccgcucccaaggcaaacggguccgaggccucuggacaggaucuggugccuaccgcggucgaacaagcuguuccaauccagccgguggccggugcaucacucgccgcucccgcagccggccagauuaaucagauagacccuuggaucuuccaaaacuuuguacagugcccacuuggggaguucaguauuagccccaggaauacaccuggagaaauccuguuugauuuggcuuuaggcccaggucugaaccccuaccuagcccaccucuccgcgauguauacugggugggugggaaauauggagguccagcuggugcuugcaggcaacgccuucacggcuggcaaaguuguggucgcccuggugccuccauacuuuccgaaggggucuuugaccacagcacagauuacuuguuucccccauguaaugugcgacguucggacccucgaaccuauccaacugccacugcucgaugugcgccgagucuuauggcacgcuacacaggaccaggaggagucgaugcgucugguguguaugcuuuauacccccuugagaacuaauucaccuggagaugaauccuuuguggucagugguaggcugcuauccaaaccagccgcggacuucaacuuuguuuaccucacacccccgauagagcggaccaucuaucgcaugguggaucugccugcccuucagcccagacugugcacgcaugcaagguggccagcuccuguauacggcuugcucguggaccccucucugccaagcagcccccaauggcagaaugggcggguccacguggauggaacuuuacugggcaccacaccuguuucagguaguugggugagcuguuucgccgcugaagccgcauaugaguuucagucugggacuggagaggucgccaccuccacacucauugaacaagacggcucagcuuacgugccaggcgagcgcgcggcaccgcuuggguaccccgauuucagcggacagcuggaaaucgagguacagaccgaaacgacuaaggccggugacaaauugcgaguuacaaccuuugagaugauucuaggcccuacuacaaacguggaccaggcuccauaucaagggagagucuacgccagucugaccgcagccgcuucucucgaucugguggacggaaggguccgggccgugccccguuccaucuauggcuuccaggauguuauaccugaguacaaugacggucuucuggugccauuggcacccccgauugggccuuuccucccaggcgaaguacuguuacgcuuuagaacguauaugaggcagaucgauagcucggacgcggcugccgaggcaauugauugcgcccugccccaggaauuuaucucuugguuugcuuccaacgccuucaccguccaaucagaggcacuacuccugcgguaccgaaauacacuuacuggacaguugcuguuugaauguaagcucuauagugagggcuacaucgcucugagcuacuccgggucuggaccucuugccuuccccaccgacgguuucuucgaggugguuagcugggugccacgccuguaucaguuggcgucagucggcagucucgccacagggagaacucugaagcaguga

SEQ ID NO: 19211 - RNA, 1626 nt, Artificial Sequence
  derived and/or modified sequence opt3 from capsid_protein__Norovirus__ABP99041
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguacuucagcccagacugugcacgcaugcaagguggccagcuccuguguacggcuugcucgucgaccccucccugccaucuaauccccaauggcagaacgggcgggugcacguugauggaacuuuacugggcaccacaccugugagcgguuccugggucucauguuucgccgcugaagccgcauaugaguuucagagugggacuggagagguggccaccuucacaaugauugaacaagacggcagcgcuuacguaccaggcgaucgcgcggcaccgcucggguaccccgacuuuucuggacagcuugagaucgaaguucagaccgagacgacuaaggccggugacaaacugaaggugacaaccuucgauaugauuuugggcccuacuacaaaugucgaccaggcuccauaucaagggcgagccuacgcaucccuaaccgccgcugccucacuggaucucguggacggaagagucagggcagugccccggagcaucuauaguuuccaggaugaacugccugaguacaacgacggccuucugguuccauuggcgcccccgcucgguccuuuucugccaggggagguguuacugcguuuccgcacguauaugagacagcuagauaccgcugacgccucugcacagcccauagauugcgcccucccucaagaauuuauuuccugguucgcuagcaauaacuuuacaguacagucggacgcccugcuugucagguaccggaauacuuugaccggccagcuccuguucgaggcaaagcuguauucugaaggauacaucgcuguguccuacucaggcagugggccccuuacauuuccaacugauggauucuuugagguugugagcugggucccucgacuguuccaguuggccuccguggguucucucgcgaccggccgcacacugaaacaauga

SEQ ID NO: 19212 - RNA, 1623 nt, Artificial Sequence
  derived and/or modified sequence opt3 from capsid_protein__Norovirus__ABQ12784
augaagauggccagcaacgacgcuacccccuccgauggcucugcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuacaguuucaccaaggaaugcccccggggagauccuuuggagugcuccucugggaccagauuugaaccccuacuuaagccaccuggcccggauguauaauggcuacgcggguggguucgaagugcaggucauucuagcaggaaacgccuuuacugcuggcaaaaucauuuucgccgcagugccuccaaauuuuccgacggagggccucucccccucucagguaaccauguucccucauaucauaguugacgugcgccaacuggagccaguccuuaucccccugccugaugugcgaaacaauuuuuaucacuacaaccagucgaaugacccaacaauuaaguugaucgcuaugcucuauacuccccugcgugccaacaacgcgggggaugacguguucaccgucucaugcagaguucugacaaggccgagcccugauuuugacuucauuuuucucgugcccccaaccguagaaagucggacuaaaccuuucuccgugcccaucuuaacagucgaggaaaugaccaauucucgcuuuccaauaccccuggagaaacuuuucacgggaccuagcuccucauucgugguucagccacagaacgguagauguacuaccgauggcguguugcuggggacaacucaacuaaguccggucaauauuugcaccuuuaggggagacgugacacauaucgccggcacccagaacuacacgaugaaucucgcaagccagaacuggaauaacuaugaucccacugaggaaauuccugcuccacuggguacacccgacuucguagggaagauccagggaguucuuacccaaacuacacggcgcgacggcucuacccgaggccacaaggccacgguguccaccgggucaguccauuuuacaccuaagcugggaagcgugcaguucaguacugauaccucuaaugacuuugagacaggucagaacacuagauucaccccagucggcgugguucaagauggguccacaacuccccagaaugaaccgcagcaguggguguugccugacuacagcggaagggauucgcacaacguacaccucgcuccagccgucgcacccaccuuuccuggcgagcaacuguuauucuuucggucuacgaugcccgguuguuccggguacccaaauaugaaccuggacugccuccuuccucaggaaugggugcagcauuucuaucaggagucagcccccgcucaaagugauguugcgcuguugcguuuugugaauccagacacaggccgcguccuauucgaguguaaacugcacaagagcggauacgugaccguagcacauacuggccagcacgaucucgugaucccgccuaacggguauuuuagauucgacuccuggguuaaccaguucuacacccuggcccccaugggaaauggugcuggcaggcggcgagcccuuuga

SEQ ID NO: 19213 - RNA, 1737 nt, Artificial Sequence
  derived and/or modified sequence opt3 from capsid_protein__Norovirus__ABR15783
augaagauggccagcuccgacgcuacccccucuucagauggcgcagggaaccuggugccugagagucagcaagaaguccucccacuugccccgguugcgggagcugcccuggcagcccccgugguaggucagcagaauaucauugacccuuggauaaaagagaacuucgugcaggcuccacaaggcgaauuuacagucagccccaaaaauuccccuggggagguguugguuaacuuagaacugucuccaagacuaaaucccuaccuccaccaucugucgaagauguauaacgcauacgccggaggcauggagguggagaucauucuugcugguaaugccuucacugcggggaagguccugaucgcagccgugccuccaaacuuuccgauugaaaauguaucagcuagccaggccagucaguucccccacguuaucguggaugucaggacguuggagccuauacggcucccacugcccgacgugcgcaccaacuuuuuccauuauacaacucaggaagaaccucgaaugcguaucguggcauggcuguacaccccacucagaacaaauggauccggcgaugacucuuuuaccgucagcggcaggauuuuaacucggcccuccccggauuucgaguuuucauuccugguuccucccacaguggaaaccaaaacgguaaguuuuagcgugccagggcuugucgugcaagacaugucuaacucccgcuggccugcucagaucucaggauugguugugagagguaaugaggcccaggucgugcacuuccagaacgggaggugcacuaccgaaggcaugcugcuaggaacaacuacccucaauauuaacagcaucuguggccugcggggucuuaguguaucucaagcguccguucgcggggcccccgcacugacagaggaaaugccacccuuggaggaugagguggcugacggagccgcugccaccuauacgcucacucgagcagccgauacagcucugugguuaagagucgaggagccugacggcaggccauacgauauauuuggcgaccagccggcgccccuggggaccccugacuucacugcagugauugucggaacagccauccggccacguaccacgagcggugcuuaucuccaugaugccuacguggacaccacacccggcgaugcagacuucacuccuucgaccgggaacacaaagauuguucuucgcggaggcgguucugggcacgugggccagggacacuacuggcaauuuaagccaaucgccguagaaggcgggggauccagaccccaguaucaggaguacaaucugccggauuaugcugguccuacugccucaaaccaugacuuggcaccacccgucgcgccuaggaugcccggcgaacuacugcuccuguucgagagugauaugccagugugggacaauggggcuggagccgccccugcacagaaaauccacugccuucugcccaacgaguuuauuacccauuuguucgaucuccaagcuccagcccuggcagaagcugccuuacugcgguacguucacccggacagcggccgaacacuauuugaguguaagcucuaucgcgaagguuacaugguggucgcggccccuguggggagacugaauuucccccuugauggcuauuuuagguucgacuccuggguaucugcuuuuuacguguugagcccaguuggaucaggccaggggcggcgcggaagaaguaaagcagccuga

SEQ ID NO: 19214 - RNA, 807 nt, Artificial Sequence
  derived and/or modified sequence opt3 from capsid_protein__Norovirus__ABR24136
auggccggcgcuuucuuugcagggcuggccagcgacgugcucggauccggucuuggcucucugaucaacgcgggggcuggagccauuaaucagaaggucgaguucgaaaacaauagaaaauugcaacaggcaucauuugaguucaguagcaacuuacagcaggccuccuuucaacacgauaaggaaaugcugcaggcucagauagaggcaaccaaaaagcuacagcaaggcaugaugaaaguuaagcaggccaugcuccuggaagguggguucucugagacagacgcugccaggggagcgaucaaugcacccaugacuaaggcccuugauuggucgggcacgcgguacugggcuccugacgcccgcaccacaacuuauaacgcaggccgauuuucaaccccacagccgagcggggcucugcccggacguacaaauccuagagccaccgugccagcgagggguagucccuccacuccuucuaacacaagcaccguaacguccguguacucagaucagacugucaguacccgguugggcagcacagccgggucuggaacucgcguguccucacucccaagcaccgcaagaacaaggaguuggguugaggaccaaaaucggaaccugucucccuucaugcgcggcgcucauaauauuuccuuugugaccccuccagccagccgaucgucuucccaggguacggucucaacugugccgaaagaaguacuggauaguuggacaggggcuuucaacaccagaaggcagccccucuuugcccacauccggaagcguggagagagccgcgcauga

SEQ ID NO: 19215 - RNA, 1647 nt, Artificial Sequence
  derived and/or modified sequence opt3 from capsid_protein__Norovirus__ABS12173
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcaggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugauugcgaugcuguacacaccccucagagccaauaacucuggagacgauguuuucacugugucguguagggucuuaacccggccuucaccagacuuuagcuucaauuuucuggugcccccgacaguggaaaguaagaccaaaccuuucacucuucccaucuugacaauauccgagaugucuaacagccgcuuuccagucccuauugauucccugcauaccucacccacggaaaauaucguugugcagugccagaacgguagaguaacucuagacggcgagcucauggggaccacacaacugcuuccaagucagauuugugcauucaggggagugcugacucggagcaccucucgccccuccgaucaggcugacacagccaccccucgauuguucaauuauuacuggcacauccagcucgacaaccugaauggcacgccauaugauccggcugaggacauccccgguccuuuagggacuccagauuuuagaggaaaggucuucggcguggccucacaaaggaaccccgacagcacaacccgggcacaugaagccaaaguugauacuacagcuggccguuuuaccccuaagcuggggagucucgagauuucuacggaauccggagacuucgaucagaaucagccaacccgcuuuacacccguggguauaggcgucgaccacgaggcggauuuccaacaguggagccuuccggacuacucggggcaguuuacucacaacaugaaucuggcgccugccguggcuccaaacuuccccggagaacaguugcuauuuuucagaucucaacugccuuccucaggcgguaggaguaaugggauccucgauugccugguaccccaggaguggguucagcauuuuuaccaggagagcgccccagcacaaacccagguggcccuuguccgguaugugaacccugacacaggccgaguccuguucgaagcuaaguugcacaaacucggauuuaugacuauugccaagaacggcgacucccccaucaccgugccaccgaauggguacuuccgcuucgagucuuggguuaacccuuuuuauacacuggcacccaugggaaccgguaauggcagaaggcggauacaguga

SEQ ID NO: 19216 - RNA, 1611 nt, Artificial Sequence
  derived and/or modified sequence opt3 from capsid_protein__Norovirus__ABS12175
augaagauggccagcaacgacgcuacccccuccgaugacggcgcagccgggcuggugccugagaucaauucugaagucauggcgcucgagccaguugcuggagccucacuugcagccccggugguaggucagcaaaacauuauagaucccuggaucagaaauaacuucgugcaggcuccugcaggcgaauuuacagucaguccaagaaauagccccggggagcuguuguuagaccuggaacuaggaccugagcucaacccauaccuggcccaccuugcucggauguauaauggccaugccggugggauggaggugcagauuguucuggcgggaaacgcauucacugccggcaaaaucuuguuugcugccauucccccuuccuucccauacgaaaaucucucuccggcacagcugacgaugugcccccacgugaucgucgaugugcgccaacuggagccuguacucuuaccaaugcccgacauacgaaacguguuuuaucauuacaaucagaacaauucgccuaagcugcgucuuguugcuauguuguauaccccacugagagccaacaauucaggcgaugacgucuucacagugagcuguagggugcuaacucggcccaguccggauuuucaguucaccuuucucgucccucccacaguugaauccaaaaccaagaacuucacucugccagugcuucgcguaucugagaugacaaacagcagauuuccugugguccuggaccagauguacaccuccaggaaugagaacaucauugugcaaccccagaaugggcggugcacgacugauggagaauugcucgguaccacaauccugcagucaguuaguauuuguaacuucaaaggcacuaugcaggcgaaguuaaaugaggaaccacgcuaucaacugcagcucaccaaccuugacgggagccccaucgauccuacagacgacaugccagccccgcugggaacccccgauuuucaggcaauguuguacggcguggcuucucaacgauccucaagagacaaugccacgagggcucacgaugcccagauagacacugccggugauacauucgcaccuaagauugggcagguccgguucaaaagcaguucuaacgacuuugaucuacaugacccaaccaaguucacucccaucggagugaauguagaugaccagcacccuuuucgucaaugguuccugccaaacuacggcggccaccucgcucugaauaaccaucuugcgcccgcaguuacaccgcuguuuccuggggagcagauuuuguucuuucgcuccuauaucccaagcgccggaggucacaccgauggcgcuauggacugccuccugccccaggaauggguggagcauuucuaccaggaggccgcaccuucgcaaucugacaucgccuuagucagauuuauuaaucccgauacggggagggugcuguucgaagcuaaacuacacaagcagggauuucucaccauagccgcauccggcgaccacccaaucgucaugccuacaaacgguuauuuccgguuugaggcgugggugaaucccuucuacacucuggcuccaguugggaccggcucaggacgacgcaggauucaguga

SEQ ID NO: 19217 - RNA, 1626 nt, Artificial Sequence
  derived and/or modified sequence opt3 from capsid_protein__Norovirus__ABS29273
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguaauucagcccagacuuugcacgcaugcaagguggccagcuccuaucuacggccuguugguggaccccucccucccaucuaauccccaauggcagaacgggcggguccacguggauggaacucuguuaggcaccacaccuauuagcgguuccuggguuucauguuucgccgcugaagccgcauaugaguuucagagugggaucggagagguggccacuuucacccugauagaacaagacggcagcgcuuacgucccaggcgaucgcgcggcaccgcucggguaccccgacuuuucuggacagcuugagauugaagugcagacagagaccacgaagacuggugacaaacugaagguaacaaccuucgaaaugaucuugggcccuacuacaaaugccgaucaggcuccauaucaagggcgaguuuucgccuccgugaccgcagccgcuucacuagaccuggucgauggaagagugagggccgucccccggagcguguacaguuuuugcgacacgauuccugaguauaacgauggccuccugguuccacuugcacccccgaucgguccuuuccugccaggggagguguugcuccguuuucgcaccuacaugagacagcuggacacagcggaugcugccgcagaagccaucgacugugcuuuaccccaggaguucguaucuugguuugccuccaaugcauucacuguccagagcgaagcucugcuacucagguaucggaacacccugacaggccaacuuuuguuugagugcaagcuguacucggaaggauauauugcccucucuuacuccggcucagggccucugacuuuccccaccgauggauuuuucgaggugguuaguugggugccacgacuuuaccagcuggcgagcgucgguuccuuggccacaggccgcacccucaaacaguga

SEQ ID NO: 19218 - RNA, 1626 nt, Artificial Sequence
  derived and/or modified sequence opt3 from capsid_protein__Norovirus__ABS29275
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguaauucagcccagacuuugcacgcaugcaagguggccagcuccuguguacggccuguuggucgaccccucccucccaucuaauccccaauggcagaacgggcgggugcacguugauggaacucuguuaggcaccacaccuaucagcgguuccugggugucauguuucgccgcugaagccgcauaugaguuucagagugggauuggagaggucgccacuuucacccugaucgaacaagacggcagcgcuuacauaccaggcgaucgcgcggcaccgcucggguaccccgacuuuucuggacagcuugagauugaagugcagacagagaccacgaagacuggugacaaacugaagguaacaaccuucgaaaugguuuugggcccuacuacaaauguggaucaggccccauaucaagggcgagucuacgcuuccgugaccgccgcagccucacuagaccuggucgauggaagagugagggcuguuccccggagcaucuauaguuuccaggacacgauuccugaguacaacgauggccuccuggugccacuugcacccccgaucgguccuuuucugccaggggagguauugcuccguuuccgcaccuauaugagacagcuggacacagccgaugcggcugccgaagcaaucgacugcgccuuaccccaggaguuugucucuugguucgcuuccaaugccuuuacugugcaaagcgaagcacugcuacucagguaccggaacacccugacaggccagcuuuuguucgaguguaagcuguauucggaaggauacauugcucucucuuacuccggcucagggccucugacuuuucccaccgauggauucuuugagguugugaguugggucccacgacuuuaucagcuggccagcguggguuccuuggcgacaggccgcacccucaaacaguga

SEQ ID NO: 19219 - RNA, 1626 nt, Artificial Sequence
  derived and/or modified sequence opt3 from capsid_protein__Norovirus__ABU55541
augagaaugagcgacggcgccgcucccaaggcaaacggguccgaggccucuggacaggaucuggugccugcggcugucgaacaagccguuccaauccagccgguggccggugcagcucucgcagcccccgcugccggccagauuaaucagauagacccuuggaucuuccaaaacuuuguacagugcccacuuggggaguucucaauuagucccaggaauaccccuggagaaauccuguuugauuuggcguuaggcccaggucugaaccccuaccuagcacaccucagcgccauguauacagggugggugggaaauauggagguccagcuggugcuugcuggcaacgccuucacugcaggcaaaguuguggucgcucuggugccuccauacuuuccgaagggguccuugacgaccgcccagauuacauguuucccccauguaaugugcgacguucggacucucgaaccuauccaacugccacugcucgaugugcgccgagucuuauggcacgcgacccaggaccaggaggagucuaugcgucugguguguaugcuuuauacacccuugagaaccaauucgccuggagaugaaucauuuguggucagcgguaggcugcuaaguaaaccagccgcagacuucaacuuuguuuaccucacucccccgauagagcggacaaucuaucgcaugguggaucugccuguaauucagcccagacuuugcacccaugcuagguggccagccccuguguacggccuguuggucgaccccucccucccaucuaauccccaauggcagaacgggcgggugcacguugauggaacgcuguuaggcacuaccccuaucagcgguuccugggugucauguuucgcugccgaagcagccuauaaguuucagagugggacaggagaggucgcuacuuucacccugauugagcaagacggcagcgcguacgugccaggcgaucgcgcagccccgcucggguaccccgacuuuucuggacagcuugaaaucgagguacagacagaaaccacgaaaacuggugacaagcugaagguuacaaccuucgagaugauauugggcccuacuacaaaugcugaucaggccccauaucaagggcgaguguucgcauccgucaccgccgcugccucacuagaccugguggauggaagagucagggcagugccccggagcauuuacggcuuucaggacacgaucccugaauauaacgauggucuccugguuccacuugcgcccccgauugggccuuuccugccaggcgagguguugcuccguuuucgcaccuacaugagacagaucgacacagcugaugccgcagccgaggcuaucgacugcgcccugccccaggaguucguaaguugguuugcaucuaaugcuuucacuguccaauccgaagccuuacugcuaagguaucggaacacccucacaggacagcugcuuuuugaauguaaauuguacaaugagggcuauauugcgcugagcuacucggggucuggaccucucacuuuccccaccgaugguauauuugaagugguuuccugggugccacgacuguaccagcuugccucagucggcagucuggcuacagggcgcauguugaagcaguga

SEQ ID NO: 19220 - RNA, 1626 nt, Artificial Sequence; identical to SEQ ID NO: 19219
  derived and/or modified sequence opt3 from capsid_protein__Norovirus__ABU55544

SEQ ID NO: 19221 - RNA, 1626 nt, Artificial Sequence
  derived and/or modified sequence opt3 from capsid_protein__Norovirus__ABU55547
augagaaugagcgacggcgccgcucccaaggcaaacggguccgaggccucuggacaggaucuggugccugcggcugucgaacaagccguuccaauccagccgguggccggugcagcucucgcagcccccgcugccggccagauuaaucagauagacccuuggaucuuccaaaacuuuguacagugcccacuuggggaguucucaauuagucccaggaauaccccuggagaaauccuguuugauuuggcguuaggcccaggucugaaccccuaccuagcacaccucagcgccauguauacagggugggugggaaauauggagguccagcuggugcuugcuggcaacgccuucacugcaggcaaaguuguggucgcucuggugccuccauacuuuccgaagggguccuugacgaccgcccagauuacauguuucccccauguaaugugcgacguucggacucucgaaccuauccaacugccacugcucgaugugcgccgagucuuauggcacgcgacccaggaccaggaggagucuaugcgucugguguguaugcuuuauacacccuugagaaccaauucgccuggagaugaaucauuuguggucagcgguaggcugcuaaguaaaccagccgcagacuucaacuuuguuuaccucacucccccgauagagcggacaaucuaucgcaugguggaucugccuguaauucagcccagacuuugcacccaugcuagguggccagccccuguguacggccuguuggucgaccccucccucccaucuaauccccaauggcagaacgggcgggugcacguugauggaacgcuguuaggcacuaccccuaucagcgguuccugggugucauguuucgcugccgaagcagccuauaaguuucagagugggacaggagaggucgcuacuuucacccugauugagcaagacggcagcgcguacgugccaggcgaucgcgcagccccgcucggguaccccgacuuuucuggacagcuugaaaucgagguacagacagaaaccacgaaaacuggugacaagcugaagguuacaaccuucgagaugauauugggcccuacuacaaaugcugaucaggccccauaucaagggcgaguguucgcauccgucaccgccgcugccucacuagaccugguggauagcagagucagggcagugccccggaguauuuacggauuucaggacacgaucccugaauauaacgauggccuccugguuccacuugcgcccccgauugguccuuuccugccaggggagguguugcuccguuuucgcaccuacaugagacagaucgacacagcugaugccgcagccgaggcuaucgacugcgcccugccccaggaguucguaucuugguuugcauccaaugcuuucacuguccaaagcgaagccuuacugcuaagguaucggaacacccucacaggccagcugcuuuuugaauguaaauuguacaaugagggauauauugcgcugucguacucuggcuccgggccucucacuuuccccaccgauggaauauuugaagugguuucaugggugccacgacuguaccagcuugccagugucgguagccuggcuacaggccgcauguugaagcaguga

SEQ ID NO: 19222 - RNA, 1626 nt, Artificial Sequence; identical to SEQ ID NO: 19219
  derived and/or modified sequence opt3 from capsid_protein__Norovirus__ABU55550

SEQ ID NO: 19223 - RNA, 1626 nt, Artificial Sequence; identical to SEQ ID NO: 19219
  derived and/or modified sequence opt3 from capsid_protein__Norovirus__ABU55553

SEQ ID NO: 19224 - RNA, 1626 nt, Artificial Sequence
  derived and/or modified sequence opt3 from capsid_protein__Norovirus__ABU55556
augagaaugagcgacggcgccgcucccaaggcaaacggguccgaugccucuggacaggaccuggugccugcggcugucgagcaagccguuccaauccagccgguggccggugcagcucucgcagcccccgcugccggccagauuaaucagauagauccuuggaucuuccaaaacuuuguacagugcccacuuggggaguucucaauuagucccaggaauaccccuggagaaauccuguuugacuuggcguuaggcccaggucugaaccccuaccuagcacaccucagcgccauguauacagggugggugggaaauauggaaguccagcuggugcuugcuggcaacgccuucacugcaggcaaaguuguggucgcucuggugccuccauacuuuccgaagggguccuugacgaccgcccagauuacauguuucccccauguaaugugcgauguucggacucucgagccuauccaacugccacugcucgacgugcgccgagucuuauggcacgcgacccaggaucaggaagagucuaugcgucugguguguaugcuuuauacacccuugagaaccaauucgccuggagacgagucauuuguggucagcgguaggcugcuaaguaaaccagccgcagauuucaacuuuguuuaccucacucccccgauagaacggacaaucuaucgcaugguggaccugccuguaauucagcccagacuuugcacccaugcuagguggccagccccuguguacggccuguuggucgaucccucccucccaucuaauccccaauggcagaacgggcgggugcacguugacggaacgcuguuaggcacuaccccuaucagcgguuccugggugucauguuucgcugccgaggcagccuauaaguuucagagugggacaggagaagucgcuacuuucacccugauugagcaagauggcagcgcguacgugccaggcgaccgcgcagccccgcucggguaccccgacuuuucuggacagcuugagaucgaaguacagacagagaccacgaaaacuggugauaagcugaagguuacaaccuucgaaaugauauugggcccuacuacaaaugcugaccaggccccauaucaagggcgaguguucgcauccgucaccgccgcugccucacuagaucugguggacggaagagucagggcagugccccggagcauuuacggcuuucaggauacgaucccugaguauaacgacggucuccugguuccacuugcgcccccgauugggccuuuccugccaggcgaaguguugcuccguuuucgcaccuacaugagacagaucgauacagcugacgccgcagccgaggcuaucgauugcgcccugccccaggaguucguaaguugguuugcaucuaaugcuuucacuguccaauccgaagccuuacugcuaagguaucggaacacccucacaggacagcugcuuuuugaguguaaauuguacaaugaaggcuauauugcgcugagcuacucggggucuggaccucucacuuuccccaccgacgguauauuugaggugguuuccugggugccacgacuguaccagcuugccucagucggcagucuggcuacagggcgcauguugaagcaguga

SEQ ID NO: 19225 - RNA, 1626 nt, Artificial Sequence
  derived and/or modified sequence opt3 from capsid_protein__Norovirus__ABU55559
augagaaugagcgacggcgccgcucccaaggcaaacggguccgaggccucuggacaggaucuggugccugcggcugucgaacaagccguuccaauccagccgguggccggugcagcucucgcagcccccgcugccggccagauuaaucagauagacccuuggaucuuccaaaacuuuguacagugcccacuuggggaguucucaauuagucccaggaauaccccuggagaaauccuguuugauuuggcguuaggcccaggucugaaccccuaccuagcacaccucagcgccauguauacagggugggugggaaauauggagguccagcuggugcuugcuggcaacgccuucacugcaggcaaaguuguggucgcucuggugccuccauacuuuccgaagggguccuugacgaccgcccagauuacauguuucccccauguaaugugcgacguucggacucucgaaccuauccaacugccacugcucgaugugcgccgagucuuauggcacgcgacccaggaccaggaggagucuaugcgucugguguguaugcuuuauacacccuugagaaccaauucgccuggagaugaaucauuuguggucagcgguaggcugcuaaguaaaccagccgcagacuucaacuuuguuuaccucacucccccgauagagcggacaaucuaucgcaugguggaucugccuguaauucagcccagacuuugcacccaugcuagguggccagccccuguguacggccuguuggucgaccccucccucccaucuaauccccaauggcagaacgggcgggugcacguugauggaacgcuguuaggcacuaccccuaucagcgguuccugggugucauguuucgcugccgaagcagccuaugaguuucagagugggacaggagaggucgcuacuuucacccugauugaacaagacggcagcgcguacgugccaggcgaucgcgcagccccgcucggguaccccgacuuuucuggacagcuugagaucgaaguacagacagagaccacgaagacuggugacaaacugaagguuacaaccuucgaaaugauauugggcccuacuacaaaugcugaucaggccccauaucaagggcgaguguucgcauccgucaccgccgcugccucacuagaccugguggauggaagagucagggcagugccccggagcauuuacggcuuucaggacacgaucccugaguauaacgauggucuccugguuccacuugcgcccccgauugggccuuuccugccaggcgagguguugcuccguuuucgcaccuacaugagacagaucgacacagcugaugccgcagccgaagcuaucgacugcgcccugccccaggaguucguaaguugguuugcaucuaaugcuuucacuguccaauccgaagccuuacugcuaagguaucggaacacccucacaggacagcugcuuuuugaguguaaguuguacaaugaaggcuauauugcgcugagcuacucggggucuggaccucucacuuuccccaccgaugguauauuugaggugguuuccugggugccacgacuguaccagcuugccucagucggcagucuggcuacagggcgcauguugaaacaguga

SEQ ID NO: 19226 - RNA, 1626 nt, Artificial Sequence; identical to SEQ ID NO: 19219
  derived and/or modified sequence opt3 from capsid_protein__Norovirus__ABU55562

SEQ ID NO: 19227 - RNA, 1626 nt, Artificial Sequence; identical to SEQ ID NO: 19219
  derived and/or modified sequence opt3 from capsid_protein__Norovirus__ABU55565

SEQ ID NO: 19228 - RNA, 1626 nt, Artificial Sequence
  derived and/or modified sequence opt3 from capsid_protein__Norovirus__ABU55568
augagaaugagcgacggcgccgcucccaaggcaaacggguccgaggccucuggacaggauuucgugccugcggcugucgaacaagccguuccaauccagccgguggccggugcagcucuggcagcccccgcugccggccagauuaaucagauagacccuuggaucuuucaaaacuucguacagugcccacucggggaguuuucaauuagucccaggaauaccccuggagaaauccuuuucgaucuggcguugggcccagguuuaaaccccuaccuggcacaccuaagcgccauguauacagggugggugggaaauauggagguccagcucgugcuggcuggcaacgccuuuacugcaggcaaaguuguggucgcucuugugccuccauacuucccgaaggggucccugacgaccgcccagauuacauguuuuccccauguaaugugcgacguucggacuuuggaaccuauccaacucccacugcuggaugugcgccgaguccucuggcacgcgacccaggaccaggaggagucuaugcguuuaguguguaugcuguauacaccccuuagaaccaauucgccuggagaugaaucauucguggucagcgguagguugcugaguaaaccagccgcagacuuuaacuucguuuaccuaacucccccgauagagcggacaguguaucgcaugguagaucucccugugcugcagcccagacuuugcacccaugcuagguggccagccccugucuacggccuguugaucgaccccucccucccaucuaauccccaauggcagaacgggcgggugcacguuaauggaacgcuguuaggcacuaccccugugagcgguuccugggucucauguuuugcugccgaagcagccuaugaguuccagagugggauuggagagguggcuacauuuacuaugaucgaacaagauggcagcgcguacguaccaggcgaccgcgcagccccgcugggguaccccgauuucucuggacagcucgagauugaaguucagaccgagacaaccaaguccggugacaaacuuaaggugacgacuuucgaaaugauccugggcccuacaaccaacgcugaccagacuccauaucaagggaaggucuacgccucaauagcagccgcugccagcuuggaucuaguggacggacgagucagagcagugcccaggaguguuuaugcguuucaggaugugcugccugaguacaaugacggccuccugguaccacuugcucccccgcuggguccuuucuugccaggggagguccuccugcgguuucguacauaugugcgccaguuagauaccgccgacgcagccgcucagcccauugauugcgcccugccucaagaguucaucucuugguuugcauccaacaauuucacgguucagagcgacgcucuacucauuagauacaggaacacccugacaggccagcuuuuguuugaagccaaacuguauucggaaggauacaucgcggugucuuacuccggcucagggccccucacuuucccaaccgauggauuuuucgaggucgugaguuggguaccucggcuguuucagcuugccagcguggguucccuggcuacaggccgaacuuugaagcaauga

SEQ ID NO: 19229 - RNA, 1626 nt, Artificial Sequence
  derived and/or modified sequence opt3 from capsid_protein__Norovirus__ABU55571
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccguguaucgcaugguagaucugccugugcuucagcccagacugugcacgcaugcaagguggccagcuccuaucuacggcuugcucauugaccccucccugccaucuaauccccaauggcagaacgggcggguccacgugaauggaacuuuacugggcaccacaccuguuagcgguuccugggugucauguuucgccgcugaagccgcauaugaguuucagagugggacuggagaggucgccaccuucacaaugaucgaacaagauggcagcgcuuacgugccaggcgaccgcgcggcaccgcucggguaccccgauuuuucuggacagcuugagauugaaguacagaccgagacgacuaagacaggugacaaacugaagguuaccacuuucgaaaugguguugggcccuacaaccaacgucgaccaggccccauaucaagggcgaacguacgcuucccuaaccgccgcagccucacuggaucucguggacggaagagucagggcugugccccggagcaucuauaguuuccaggauguucugccugaguacaaugacggccuucuggugccauuggcacccccgcucgguccuuuucugccaggggagguauuacugcguuuccgcacauauaugagacagcuagauacugccgacgcggcugcccagcccauagauugcgcacucccucaagaauuuauuucuugguucgccuccaacaauuuuaccguccagagcgacgcucugcuuaucagguaccggaacacauugacuggccagcuccuguucgaggccaagcuguauucggaaggauacauugcagugucuuacuccggcucagggccccuuaccuuuccaacagauggauucuuugagguugugaguugggucccucgacuguuccaguuggcuagcguggguucccucgccaccggccgcacucugaaacaauga

SEQ ID NO: 19230 - RNA, 1626 nt, Artificial Sequence
  derived and/or modified sequence opt3 from capsid_protein__Norovirus__ABU55577
augagaaugagcgacggcgccgcucccaaggcaaacggguccgaggccaucggacaggaucuggugccuaccgcggucgaacaagcuguuccaauucagccgguggccggugcagcccucgcugcacccgccgcuggccagauaaaucagaucgacccuuggauuuuccaaaacuuuguacagugcccacuuggggaguucucuaucucacccaggaauacaccuggagaaauucuguuugauuuggccuuaggcccaggucugaaccccuaccuagcgcaccucagugcaauguauacugggugggugggaaauauggagguccagcuggugcuugccggcaacgcuuucacggccggcaaaguuguggucgcacuggugccuccauacuuuccgaaggggagcuugaccacagcucagaucacuuguuucccccauguaaugugcgacguucgggcccucgaaccuauacaacugccacugcucgaugugcgccgagucuuauggcacgcgacccaggaccaggaggaguccaugcgucugguguguaugcuuuauacacccuugagaaccaauucuccuggagaugaaucguuuguggucucagguaggcugcuaagcaaaccagccgcagacuucaacuuuguuuaccucacucccccgaucgagcggacaguguaucgcaugguagaucugccugugcuucagcccagacugugcacccaugcuagguggccagccccugucuacggcuugcucguggaccccagucugccauccaauccccaauggcagaacgggcggguucacgugaauggaacguuacugggcacuaccccugucucugguagcuggguguccuguuucgcugccgaagcagccuaugaguuucagucagggacaggagagguagcuacuuucaccaugauugaacaagauggcagugcguacguuccaggcgaccgcgcagccccgcucggguaccccgauuuuagcggacagcuugagaucgaagugcagacagagaccacgaagucuggugacaaacugaaggucacuacauucgaaaugauuuugggcccuaccacuaacgcugaccagacaccauaucaagggcgaguguacgccuccaucgcagccgcugcaccccuagaucuggucgacggaagagugagggccguuccucggucaguguauuucuuucaggauguacucccagaguacaaugacggccugcuugucccccuggcgccgccuuuggguccauuccuccccggggaggugcuguuacguuuucgcaccuauguuagacagcuggauacggcugacgccgcagcccagccuauagauugcgcucuaccccaagaguucauuagcugguuugccaguaacucuuucaccgugcaguccgaagcacuccugaucagguaccggaauacacuuacuggccaguugcuguuugaagcuaagcucuauagcgagggauacauugccgucucguacucuggcuccgggccacugaccuucccuacagacggauuuuucgaagugguaucaugggugccccgacuuuuucagcuggcgaguguugguagcuuggccacuggccgcacccucaaacaauga

SEQ ID NO: 19231 - RNA, 1626 nt, Artificial Sequence
  derived and/or modified sequence opt3 from capsid_protein__Norovirus__ABU55580
augagaaugagcgacggcgccgcucccaaggcaaacggguccgaggccaucggacaggaucuggugccuaccgcggucgaacaagcuguuccaauucagccgguggccggugcagcccucgcugcacccgccgcuggccagauaaaucagaucgacccuuggauuuuccaaaacuuuguacagugcccacuuggggaguucucuaucucacccaggaauacaccuggagaaauucuguuugauuuggccuuaggcccaggucugaaccccuaccuagcgcaccucagugcaauguauacugggugggugggaaauauggagguccagcuggugcuugccggcaacgcuuucacggccggcaaaguuguggucgcacuggugccuccauacuuuccgaaggggagcuugaccacagcucagaucacuuguuucccccauguaaugugcgacguucgggcccucgaaccuauacaacugccacugcucgaugugcgccgagucuuauggcacgcgacccaggaccaggaggaguccaugcgucugguguguaugcuuuauacacccuugagaaccaauucuccuggagaugaaucguuuguggucucagguaggcugcuaagcaaaccagccgcagacuucaacuuuguuuaccucacucccccgaucgagcggacaguguaucgcaugguagaucugccugugcuucagcccagacugugcacccaugcuagguggccagccccugucuacggcuugcucguggaccccagucugccauccaauccccaauggcagaacgggcggguucacgugaauggaacguuacugggcacuaccccugucucugguagcuggguguccuguuucgcugccgaagcagccuaugaguuucagucagggacaggagagguagcuacuuucaccaugauugaacaagauggcagugcguacguuccaggcgaccgcgcagccccgcucggguaccccgauuuuagcggacagcuugagaucgaagugcagacagagaccacgaagucuggugacaaacugaaggucacuacauucgaaaugauuuugggcccuaccacuaacgcugaccaggccccauaucaagggcgaguguacgcaucccuagccgcugccgcaccccuggaucucgucgacggaagagugagggcgguuccucggucaguguauuucuuucaggauguacugccagaguacaaugacggccuucugguccccuuggcuccgccucucgguccauuccugcccggggagguguuacugcguuuucgcacauauguuagacagcuagauaccgccgacgcagccgcucagccuaucgauugcgcccucccccaagaguucauaagcugguuugcaaguaacucuuucacggugcaguccgaagcucugcuuauuagguaccggaauaccuugacaggccagcugcucuuugaagccaagcuguauagcgagggauacaucgcggucucguacucuggcuccgggccacuuacuuucccuaccgacggauuuuucgaagugguaucaugggugccccgacuguuucaguuggccaguguugguagccucgcuacaggccgcacucugaaacaauga

SEQ ID NO: 19232 - RNA, 1626 nt, Artificial Sequence
  derived and/or modified sequence opt3 from capsid_protein__Norovirus__ABU55586
augagaaugagcgacggcgccgcucccaaggcaaacggguccgaggccaucggacaggaucuggugccuaccgcggucgaacaagcuguuccaauucagccgguggccggugcagcccucgcugcacccgccgcuggccagauaaaucagaucgacccuuggauuuuccaaaacuuuguacagugcccacuuggggaguucucuaucucacccaggaauacaccuggagaaauucuguuugauuuggccuuaggcccaggucugaaccccuaccuagcgcaccucagugcaauguauacugggugggugggaaauauggagguccagcuggugcuugccggcaacgcuuucacggccggcaaaguuguggucgcacuggugccuccauacuuuccgaaggggagcuugaccacagcucagaucacuuguuucccccauguaaugugcgacguucgggcccucgaaccuauacaacugccacugcucgaugugcgccgagucuuauggcacgcgacccaggaccaggaggaguccaugcgucugguguguaugcuuuauacacccuugagaaccaauucuccuggagaugaaucguuuguggucucagguaggcugcuaagcaaaccagccgcagacuucaacuuuguuuaccucacucccccgaucgagcggacaguguaucgcaugguagaucugccugugcuucagcccagacugugcacccaugcuagguggccagccccugucuacggcuugcucguggaccccagucugccauccaauccccaauggcagaacgggcggguucacgugaauggaacguuacugggcacuaccccugucucugguagcuggguguccuguuucgcugccgaagcagccuaugaguuucagucagggacaggagagguagcuacuuucaccaugauugaacaagauggcagugcguacguuccaggcgaccgcgcagccccgcucggguaccccgauuuuagcggacagcuugagaucgaagugcagacagagaccacgaagucuggugacaaacugaaggucacuacauucgaaaugauuuugggcccuaccacuaacgcugaccaggccccauaucaagggaagguguacgcaucccuagccgcugccgcaccccuggaucucgucgacggacgagugagagcgguuccuaggucaguguauuucuuucaggauguacugccagaguacaaugacggccuucugguccccuuggcuccgccucucgguccauuccugcccggggagguguuacugcgguuucguacauauguucgccagcuagauaccgccgacgcagccgcucagccuaucgauugcgcccucccccaagaguucauaagcugguuugcaaguaacucuuucacggugcaguccgacgcucugcuuauuagauacaggaauaccuugacaggccagcugcucuuugaagccaaacuguauagcgaaggauacaucgcggucucguacucuggcuccgggccacuuacuuucccuaccgauggauuuuucgaggugguaucaugggugccccggcuguuucaguuggccaguguugguagccucgcuacaggccgaacucugaagcaauga

SEQ ID NO: 19233 - RNA, 1626 nt, Artificial Sequence
  derived and/or modified sequence opt3 from capsid_protein__Norovirus__ABU55589
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccguguaucgcaugguagaucugccugugcuucagcccagacugugcacgcaugcaagguggccagcuccugucuacggcuugcucaucgaccccucccugccaucuaauccccaauggcagaacgggcgggugcacguuaauggaacuuuacugggcaccacaccugugagcgguuccugggucucauguuucgccgcugaagccgcauaugaguuucagagugggacuggagagguggccaccuucacaaugauugaacaagauggcagcgcuuacguaccaggcgaccgcgcggcaccgcucggguaccccgauuuuucuggacagcuugagaucgaaguucagaccgagacgacuaaguccggugacaaacugcgagugacaaccuucgaaaugauuuugggcccuacuacaaacgucgaccaggccccauaucaagggagaguguacgcuucacuagccgcagccgcuagccuggaucucgucgacggaagggugcgggccguuccccguaguguguauucuuuccaggauguacugccugaguacaaugacggccuucuggucccauuggcacccccgcucgguccuuuucugccaggggagguguuacugcgcuucagaaccuauaugaggcagcuagauacggcggacgcugccgcacagcccaucgauugcgcccucccucaagaauuuauauccugguucgcuagcaacaauuuuaccguucagucggacgcccugcuuauucgguaccgaaacacauugacuggccagcuccuguucgaggcaaagcuguauucugaaggauacaucgcuguguccuacucaggcagugggccccuuaccuuuccaacagauggauucuuugaggucgugagcuggguaccucgccuguuccaguuggccuccguggguucucucgcgacuggcagaacccugaagcaauga

SEQ ID NO: 19234 - RNA, 1626 nt, Artificial Sequence
  derived and/or modified sequence opt3 from capsid_protein__Norovirus__ABU55598
augagaaugagcgacggcgccgcucccaaggcauccgggucugaggccucaggacaggaucuggugccuaccgcggucgaacaagcuguuccaauccagccgguggccggugcagcccucgcugcacccgccgcuggccagauuaaccagauagacccuuggaucuuccaaaauuuuguacagugcccacuuggggaguucaguauuagccccaggaacacaccuggagaaauccuguuugauuuggccuuaggcccaggucugaaucccuaccuagcgcaccucuccgcaauguauacugggugggugggaaacauggagguccagcuggugcuugccggcaaugcuuucacggccggcaaaguuguggucgcacuggugccuccauacuuuccgaaggggucuuugaccacagcucagauuacuuguuucccccauguaaugugcgacguucggacccucgaaccuauccaacugccacugcucgaugugcgccgagucuuauggcacgccacacaggaccaggaggagucgaugcgucugguguguaugcuuuauacccccuugagaacuaacucaccuggagaugagagcuuuguggucagugguaggcugcuauccaaaccagcggccgacuucaauuuuguuuaccucacacccccgauagaacggaccaucuaucgcaugguggaucugccuguacuucagcccagacugugcacgcaugcaagguggccagcuccuguguacggcuugcucgucgaccccucucugccaagcaacccccaauggcagaaugggcgggugcacauugauggaacuuuacugggcaccacaccuguuuccgguucaugggugaguuguuucgccgcugaagccgcauaugaguuucagagcgggacuggagaggucgccaccuucacacucaucgaacaagacggcucugcuuacgugccaggcgaucgcgcggcaccgcuuggguaccccgacuuuuccggacagcuggagauugaaguacagaccgagacgacucgagccggugacaaguugaaaguuacaaccuucgaaaugauccuaggcccuacuacaaacguggaucaggcuccauaucaagggagagucuacgccucacugaccgcagccgcuagccucgaccugguggauggaaggguccgggccgugccccguaguauauauucuuuccaggacguucuuccugaguacaaugauggccuguuggugccacucgcacccccgauugguccuuuucugccaggggagguauuacugcgcuucagaacguauaugaggcaggucgacuccagcgaugcggcugccgaagcaaucgacugcgcccuaccccaggaguuugugucgugguucgcuucuaacggcuuuaccguucaauccgaagcccuccugcuucgguaccgaaauacauugacuggacagcuccuguucgaguguaagcuguauucagaaggcuacauugcacuuaguuacagcggguccggaccucugaccuuucccacagaugguuucuuugagguggucucuugggugccacgcuuguuccagcucgcuagcguaggcucacuggugacugggagaaccuuaaagcaguga

SEQ ID NO: 19235 - RNA, 1626 nt, Artificial Sequence
  derived and/or modified sequence opt3 from capsid_protein__Norovirus__ABU55601
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcauggcagaucugccugugcuucagcccagacugugcacgcaugcuagguggccagccccuguauacggcuugcucguggaccccucccugccaucuaauccccaauggcagaacgggcggguccacguggauggaacuuuacugggcaccacaccuauuagcgguuccuggguuucauguuucgcugccgaagcagccuaugaguuucagagugggacuggagagguggcuacccucacacuuaucgaacaagacggcagcgcguacgucccaggcgaucgcgcagccccgcugggguaccccgacuucucuggacaguuggagauugaagugcagaccgagacgacuaaggcuggugacaaacuaaagguaacaaccuuugauaugauccugggcccuacuacaaauguugaccaggccccauaucaagggcgaguguacgcauccgucucaaccgccgcuagccucggacugguggauggcagagucagggccgugccccggaguauauaugguuuccaggacacgauuccugaauacaacgaugggcuucugguuccauuggcacccccgaucggcccuuuccucccaggagaggugcuguuacguuuucgcaccuauaugagacagauugacacagcggaugcugccgcagaggccaucgacugcgcucugccccaggaguucaucucuugguuugccuccaaugcauucacuguacaaagcgaagcucuacuccugagguaccggaacacccuuacaggccaguugcuguuugaauguaagcucuauucggagggguacauugcccugucuuacuccggaucagguccucuuacuuuccccaccgauggcuuuuucgaagcggucaguugggugccacgacuguaucaguuggccagcguugggucccucgcuacaggacgcacccugaaacaguga

SEQ ID NO: 19236 - RNA, 1626 nt, Artificial Sequence
  derived and/or modified sequence opt3 from capsid_protein__Norovirus__ABU55604
augagaaugagcgacggcgccgcucccagggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuaguccccggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaagguuguggucgcacuggugccuccauacuuuccgaaaggguccuugaccacagcucagauuacuuguuucccccauguaaugugcgacguucgcacccucgaaccuauccaacugccacugcucgaugugcgacgugucuuauggcacgccacacaggaccaggaggagucuaugagacugguguguaugcuuuauacccccuugaggacuaauucgccuggagaugaaucauuuguggucagcggucggcugcuaaguaagccagcggccgacuucaacuuuguuuaccucacacccccgauagagcgcaccaucuauagaaugguggaucugccuguaauucagcccaggcuuugcacgcaugcacgguggccagcuccuaucuacggccuguugguggaccccucccucccaucuaauccccaauggcagaacgggcgcguccacguggauggaacucuguuaggcaccacaccuauuagcgguuccuggguuucauguuucgccgcugaagccgcauaugaguuucagagugggacuggagagguggccaccuucacacugaucgaacaagacggcagcgcuuacgucccaggcgaucgagcggcaccgcucggguaccccgacuuuucuggacagcuugagauagaagugcagaccgagacgacuaaaacaggugacaagcugaaaguaaccacuuucgaaaugauuuugggcccuacaaccaauguugaucaggccccauaucaagggagaguguacgcuuccgucgccgcagccgcuucacuagaccugguggauggaaggguccgggccgugccccguagcaucuauggcuuccaggacguuauuccugaguacaacgauggucuccuggugccacuugcacccccgaucgggccuuuucugccaggcgagguauugcuccgcuucagaacguauaugaggcagcuggacaccgcggaugcugccgcagaagccaucgacugcgcuuuaccccaggaguuugucaguugguucgccucuaaugcauuuacagugcaauccgaagcucugcuacuccgguaccgaaacacucugaccggacagcuuuuguucgaguguaagcuguauagcgaaggcuacauugcccucucguacucuggguccggaccucugacauuucccgcggaugguuucuuugagguugugucaugggucccacgccuuuaucagcuggccagugugggcagcuuggcuacugggagaaugcucaggcaguga

SEQ ID NO: 19237 - RNA, 1626 nt, Artificial Sequence
  derived and/or modified sequence opt3 from capsid_protein__Norovirus__ABU55607
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcgcccgacuucaacuuuguuuaccucacaccgccuauagagcggaccaucuaucgcaugguggaucugcccguacuucagccaagacugugcacgcaugccagguggccugcacccguguacggcuugcucgucgacccaucccugcccucuaauccucaauggcagaacgggcgggugcagguugauggaacuuuacugggcaccacaccagugagcgguuccugggucucauguuucgcugccgaagcugccuaugaguuucaagcagggacuggagaggugguaaccuucacaaugauugaacaggacggcagugccuacguuccgggcgaucgcgcugcgccccucggguacccugacuuuagcggacagcuugagaucgaagugcagaccgagacgacuaagacaggugacaaacugcgagucaccacuuucgaaaugauuuugggcccaacaaccaauguggaucaagcacccuaucaggggagagccuacgcuucucuaacggccgcagccucccuggaccucgucgauggaagggugcgggcuguuccucguucaaucuauagcuuccaggacgagcugccagaguacaacgauggccuucuggugcccuuggccccgccucucgguccauuucugcccggggaaguauuacugcgcuucagaaccuauaugaggcagcuagacacagcagaugcggcugcccaaccuauagacugcgcacucccccaggaguuuauuaguugguucgccucuaauaacuuuacuguccaguccgaugcucugcuugugcgguaccgaaauaccuugacaggccagcuccuguucgaagccaagcuguauagcgagggauacaucgcaguuucguacucuggcuccgggccacuuacuuuuccuaccgacggauucuuugaaguggucucaugggugccccgccuguuccaauuggcuaguguagguagccucgugacaggcagaacccugaagcaguga

SEQ ID NO: 19238 - RNA, 1626 nt, Artificial Sequence
  derived and/or modified sequence opt3 from capsid_protein__Norovirus__ABU55610
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucagugagucccaggaauacaccuggagaaauucuguuugauuuggccuuaggcccaggucugaaccccuaccuagcgcaccucagcgcaauguauacugggugggucggaaauauggaggugcagcugguucuugccggcaacgcuuucacggccggcaaaguggucguggcacugguaccuccauacuuuccgaagggguccuugaccacagcucagaucacuuguuucccccauguuaugugcgacgugcggacccucgaaccuauucaacugccacugcucgauguccgccgaguguuauggcacgccacacaggaccaggaggagucuaugcgucugguguguaugcuuuauacccccuugagaacuaauucgccuucagaugagagcuuugucguuaguggaaggcugcuauccaaaccagcggccgacuucaacuuuguguaccucacacccccgaucgaacggaccauauaucgcaugguagaucugccugugcuucagcccagacugugcacgcaugcaagguggccagcuccugucuacgguuugcucguggaccccucucugccaagcaauccccaauggcagaacggccggguucacguggaugggacuuuacugggaaccacaccuaucuccggcucaugggucaguuguuucgccgcugaagccgcauaugaguuucagagcgguacuggggagguggccaccuucacacucguagaacaagacggaucugcuuacguuccaggcgaucgcgcggcaccgcuuggcuaccccgacuuuuccgggcagcuggagauugaagugcagaccgagacgacuaagccuggagaaaaauugaaggucacaaccuucgagaugauccuagguccaacuacaaauguggaccaggcccccuaucgaggcaaggucuucgcuucaauuaccacggccgcaagccugagucucguggaugggagaguuagggccgugccucggucuaucuacuccuuucaagacguaauaccagaguauaacgauggacugcuugucccccuggcuccgccuauuggcccauucuugcccggugaagugcuccugcguuuucgcaccuacaugagacaguuagacagcgccgaugcagcggcugaggccaucgacugcgcacugccucaggaguucguuucgugguuugccucuaaugcuuucacagugcaguccgaagcccuacuccugagguaucggaacacucuuaccgggcaauugcuguuugaauguaaacucuacucagagggcuauauugcacugaguuacagcggauccggcccccuuacauucccaacugauggguuuuucgaggucgugucuuggguaccucgacuguaccaguuggcuagcgugggaucacucgccaccggucgcacacugaagcaguga

SEQ ID NO: 19239 - RNA, 1626 nt, Artificial Sequence
  derived and/or modified sequence opt3 from capsid_protein__Norovirus__ABU55613
augagaaugagcgacggcgccgcucccaaggcaaacggguccgaggccucuggacaggaucuggugccuaccgcggucgaacaagcuguuccaauccagccgguggccgguucagcacucgccgcucccgcagccggccagauuaaucagauagacccuuggaucuuccaaaacuuuguacagugcccacuuggggaguucaguauuagccccaggaauacaccuggagaaauccuguuugauuuggcuuuaggcccaggucugaaccccuaccuagcccaccucuccgcgauguauacugggugggugggaaauauggagguccagcuggugcuugcaggcaacgccuucacggcuggcaaaguuguggucgcccuggugccuccauacuuuccgaaggggucuuugaccacagcacagauuacuuguuucccccauguaaugugcgacguucggacccucgaaccuauccaacugccacugcucgaugugcgccgagucuuauggcacgcuacacaggaccaggaggagucgaugcgucugguguguaugcuuuauacccccuugagaacuaauucaccuggagaugagagcuuuguggucagugguaggcugcuauccaaaccagccgcggacuucaacuuuguuuaccucacacccccgauagaacggaccaucuaucgcaugguggaucugccuguacuucagcccagacugugcacgcaugccagguggccagcaccuauuuacggcuugcucguggaccccucucugccaagcaauccccaauggcagaacgggcggguccacguggauggaacuuuacugggcaccacaccuguuuccgguucaugggugaguuguuucgcugccgaagcugccuaugaguuucagagcgggacuggagaggucgcaaccuucacacucaucgaacaagacggcucugccuacgugccaggcgaucgcgcugcgccgcuuggguaccccgacuuuuccggacagcuggagauugaaguacagaccgagacgacuaagacaggugacaaauugaagguuaccacuuucgaaaugauccuaggcccuacaaccaauguggaucaggcaccauaucaagggcgagucuacgccucacugacggcuguggccagccucgaccuggucgauggaagagugagggcaguuccccggaguauauauggcuuccaggacgugauuccugaguacaacgauggucuucugguaccauuggcucccccgaucgggccuuuucucccaggcgagguccuguuacguuuccgcaccuauaugagacagcuggacacagccgaugccgcagcggaagcuauugacugcgcccuaccccaggaguuuaucucuugguucgcauccaaugccuuuacugugcaaagcgaugcucuccugcuuagguaccggaacaccuugacaggacagcuccuguucgaauguaagcuguauucggagggcuacaucgcccuuucuuacuccgggucaggaccucugacuuuucccaccgacgguuucuuugaaguugugaguugggucccacgauuguuccagcucgcaagcgugggcucccugacaaccgggcgcacuuuaaaacaguga

SEQ ID NO: 19240 - RNA, 1626 nt, Artificial Sequence
  derived and/or modified sequence opt3 from capsid_protein__Norovirus__ABU55616
augagaaugagcgacggcgccgcucccaaggcaaacggguccgaggccucuggacaggaucuggugccuaccgcgaucgaacaagcugucccaauucagccgguugccgguucagcacucgccgcucccgcagccggccagauaaaucagaucgacccuuggauuuuccaaaacuuugugcagugcccacuuggggaguucaguaucagccccaggaauacaccuggagaaauucuguuugauuuggcuuuaggcccaggucugaaccccuaccuagcccaccucuccgcgauguauacuggguggguaggaaauauggaggugcagcugguccuugcaggcaacgccuucacggcuggcaaagugguuguggcccuggucccuccauacuuuccgaaggggucuuugaccacagcacagaucacuuguuucccccaugugaugugcgacguacggacccucgaaccuauacaacugccacugcucgauguucgccgaguguuauggcacgcuacacaggaccaggaggagucgaugcgucuggucuguaugcuuuauacccccuugagaacuaauucaccuggagaugagagcuuuguggugagugguaggcugcuauccaaaccagccgcggacuucaacuuugucuaccucacacccccgaucgaacggaccauuuaucgcaugguugaucugccugugcuucagcccagacugugcacgcaugccagguggccagcaccuaucuacggcuugcucguagaccccucucugccaagcaauccccaauggcagaacgggcgggugcacgucgauggaacuuuacugggcaccacaccuguguccgguucauggguuaguuguuucgcugccgaagcugccuaugaguuucagagcgggacuggagagguggcaaccuucacacucauugaacaagacggcucugccuacgucccaggcgaucgcgcugcgccgcuuggguaccccgacuuuuccggacagcuggagaucgaagugcagaccgagacgacuaagacaggugacaaauugaagguaaccacuuucgaaaugauacuaggcccuacaaccaauguugaucaggcaccauaucaagggaagguguacgccucacuggcugucgccgcaagccucgaccugguggauggacgagucagagccgugcccaggaguauuuauggcuuccaggacguuaucccugaguacaacgauggucuucuggugccauuggcucccccgauugggccuuuucucccaggcgagauccuguuacgguuccguacguauaugcgccagcuggacaccgccgaugcagcggcugaagccaucgacugcgcacuaccccaggaguuuauuucuugguucgccuccaaugcuuuuacaguacaagccgaugcacuccugcuuagauacaggaacacuuugaccggacagcuccuguucgaauguaaacuguauagcgagggcuacauagcucuuucguacucuggguccgccccucugacauuucccacugacggauucuuugaagucgugucauggguuccacgguuguuccagcucgcgaguguggguagccugaccacaggccgaaccuuaaagcaguga

SEQ ID NO: 19241 - RNA, 1626 nt, Artificial Sequence
  derived and/or modified sequence opt3 from capsid_protein__Norovirus__ABU55619
augagaaugagcgacggcgccgcucccaaggcaaacggguccgaggccucuggacaggaucuggugccuaccgcggucgaacaagcuguuccaauccagccgguggccgguucagcacucgccgcucccgcagccggccagauuaaucagauagacccuuggaucuuccaaaacuuuguacagugcccacuuggggaguucaguauuagccccaggaauacaccuggagaaauccuguuugauuuggcuuuaggcccaggucugaaccccuaccuagcccaccucuccgcgauguauacugggugggugggaaauauggagguccagcuggugcuugcaggcaacgccuucacggcuggcaaaguuguggucgcccuggugccuccauacuuuccgaaggggucuuugaccacagcacagauuacuuguuucccccauguaaugugcgacguucggacccucgaaccuauccaacugccacugcucgaugugcgccgagucuuauggcacgcuacacaggaccaggaggagucgaugcgucugguguguaugcuuuauacccccuugagaacuaauucaccuggagaugagagcuuuguggucagugguaggcugcuauccaaaccagccgcggacuucaacuuuguuuaccucacacccccgauagaacggaccaucuaucgcaugguggaucugccuguacuucagcccagacugugcacgcaugccagguggccagcaccuauuuacggcuugcucguggaccccucucugccaagcaauccccaauggcagaacgggcggguccacguggauggaacuuuacugggcaccacaccuguuuccgguucaugggugaguuguuucgcugccgaagcugccuaugaguuucagagcgggacuggacaagucgcaaccuucacacucaucgagcaggacggcucugccuacgugccaggcgaucgcgcugcgccgcuuggguaccccgacuuuuccggacagcuggaaauugagguacagaccgaaacgacuaaggccggugacaaauugaagguuacaaccuucgagaugauccuaggcccuacuacaaauguggaucaagccccauaucaggggcgagucuacgcuucacuggccguggcagccagccucgaccuggucgauggaagagugagggcuguuccccggaguauacauggcuuccaggacgugauuccugaauauaacgauggucuucugguaccauuggcacccccgaucgggccuuuucucccaggcgagguccuguuacguuuccgcaccuacaugagacagcuggacacggcagaugcggcugccgaggcaauugacugcgcccuaccccaagaauuuaucucuugguucgcuuccaaugccuuuaccgugcagagcgaugcacuccugcuuagguaucggaacacauugacuggacagcuccuguucgaguguaagcuguacucggaaggcuauaucgcucuuucuuacuccgggucaggaccucugaccuuucccacagacgguuucuuugagguugugaguugggucccacgauuguuccagcucgccagcgugggcucccuggcgacugggcgcaccuuaaaacaauga

SEQ ID NO: 19242 - RNA, 1626 nt, Artificial Sequence
  derived and/or modified sequence opt3 from capsid_protein__Norovirus__ABU55622
augagaaugagcgacggcgccacccccaaggcuaacggguccgaggcaucuggacaggaucuggugccuacagccgucgaacaagcgguuccaauccagccgguggcuggugccgcacucgccgcucccgcagccggccagauuaaucagauagacccuuggaucuuccaaaacuuuguacagugcccacuuggggaguucucaauuagucccaggaauacuccuggagaaauccuguuugauuuggcuuuaggcccaggucugaaccccuaccuagcccaccucagcgcgauguauacggggugggugggaaauauggagguccagcuggugcuugcaggcaacgccuucaccgcuggcaaaguuguggucgcccuggugccuccauacuuuccgaagggguccuugacaacugcacagauuaccuguuucccccauguaaugugcgacguucggacacucgaaccuauccaacugccacugcucgaugugcgccgagucuuauggcacgcuacccaggaccaggaggagucuaugcgucugguguguaugcuuuauacucccuugagaacaaauucgccuggagaugaaucauuuguggucagcgguaggcugcuaaguaaaccagccgcggacuucaacuuuguuuaccucacgcccccgauagagcggaccaucuaucgcaugguggaucugccuguaauucagcccagacuuugcacucaugccagguggccagcaccuguguacggccuguuggucgaccccucccucccaucuaauccccaauggcagaacgggcgggugcacguugauggaacccuguuaggcacaacuccuaucagcgguuccugggugucauguuucgcugccgaagcugccuaugaguuucagagugggaccggagaggucgcaacauucacccugauugaacaagacggcagcgccuacgugccaggcgaucgcgcugcgccgcucggguaccccgacuuuucuggacagcuugagaucgaaguacagacggagacuacaaagaccggugacaaacugaagguuacuacauucgaaaugauauugggcccuaccacgaauguggaucaggcaccauaucaagggcgagucuucgccuccgugaccgcugccgcaucacuagaccuggucgauggaagagugagggccguuccccggagcauuuacggcuuucaggacacaaucccugaguauaacgauggucuccuggugccacuugcucccccgauugggccuuuccugccaggcgagguauugcuccguuuucgcacuuacaugagacagcuggacaccgccgaugcagcggcugaagccaucgacugcgcauuaccccaggaguucgucaguugguuugccucuaaugcuuucacagugcaauccgaagcccugcuacucagguaucggaacacucugaccggacagcuuuuguuugaguguaagcuguacagcgaaggcuauaucgcacucucguacucuggguccggaucacugacauucccuaccgauggcuuuuucgagguugugaguugggucccccgacuuuaccagcuggcuagcguggguuccuuggccacugggcgcacgcucaaacaguga

SEQ ID NO: 19243 - RNA, 1623 nt, Artificial Sequence
  derived and/or modified sequence opt3 from capsid_protein__Norovirus__ABU55628
augagaaugagcgacggcgccgugcccaaggcuaacggguccgaggcaucuggacaggaucuggucccuaccgccguugaacaagcggugccaauccagccgguagcuggugccucaauugcagcccccgcugcaggccagauaaaucagaucgacccuuggauuuuccaaaacuuugugcagugcccacucggggaguucaguaucagccccaggaauacaccuggagaaauucuuuuugaucuggccuugggcccagguuuaaaccccuaccuggcucaccuauccgccauguauacugggugggucggaaauauggaggugcagcucguucuggcgggcaacgcauucacggccggcaaaguggucguggcucuuguaccuccauacuuuccgaaggggucucugaccacagcccagaucacuuguuucccccauguuaugugcgacgugcggaccuuggaaccuauacaacucccacugcuggauguccgccgagugcucuggcacgcaacacaggaccaggaggagucgaugcguuuaguguguaugcuguauacuccccuuagaaccaauucaccuggagaugagagcuuugucguuagugguagguugcuguccaaaccagcugccgacuucaacuuuguguaccuaacacccccgaucgaacggaccauuuaucgcaugguagaucucccugugcugcagcccagacuuugcacgcaugcgagguggccagccccuaucuacggccuguuggucgaccccucucucccaagcaauccccaauggcagaacgggcgggugcacguugauggaacucuguuaggcaccacaccuguguccgguucaugggucaguuguuucgcagcugaagccgcuuaugaguuucagagcgggacuggagagguggccaccuucacacugauugaacaagacggcucugcauacguaccaggcgaucgcgccgcuccgcucggguaccccgacuuuuccggacagcuugagaucgaaguucagaccgagacgacuaagacaggugaaaaacugaaggugaccacuuucgagaugauauugggcccugcgacaaaugucgaccaggcaccauuccaagggcgaguguaugccucacuaaccgcugucgccagccuggaucucguggacggaagaguuagggcagugccccggaguauuuacgccuuucaggauguaaucccugaguauaacgacggccugcuugucccacuggcucccccgauugguccuuucuugccaggggaacuccuguuacguuuucgcacguacaugagacagaucgauucuuccgacgccgcagcggaggcuaucgauugcgcccugccccaggaguucauuagcugguuugcaucgaaugccuucaccgugcaaucugaagcucuacuccugagguaucggaacacacuuacuggccaguugcuguuugaauguaagcucuacuccgagggauauauagcccugucauacaguggcagcgggccucuuaccuuccccgcagacggauuuuucgagguuguguccugggucccacgacuguuucaguuggcuucuguggguagcucagccacaggccgcacucucaaauga

SEQ ID NO: 19244 - RNA, 1593 nt, Artificial Sequence
  derived and/or modified sequence opt3 from capsid_protein__Norovirus__ABW74121
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggauccgguaccggcgauucuuucguggucgcugggaggguuaugacgugcccaagccccgacuuuaauuuccuguuucuugugccuccaacuguagagcagaagacccggcccuucacauugccgaaccugccucuauccucacucaguaacagccgcgcaccccugccaaucucuggaaugggcauuuccccugauaaugugcaaucaguccaguuucagaacgguagauguacucuugacgggaggcuggugggaaccacacccguuagcuugagucauguggccaaaauccggggcaccucuaauggcacggucauaaaccucacugaacuggacgggacaccauuccaccccuucgagggaccugcuccaauugguuuuccggauuuaggcgggugcgacuggcacaucaauaugacccaguucggacauuccagccaaacucaguacgauguggacacaacccccgauacguuuguaccucaccugggcucgauucaggccaacgguaucaauucugggaacuauaucggcguucucuccugggugucaccacccagucauccuagcggaucccaagucgaccuuuggaagauuccaaauuacggcucuagcauaaccgaggcgacacaccuggcccccucaguguucccgccuggguuuggagaagucuugguguucuuuaugaguaaaaucccaggucccggcgcauauucccuaccuugucugcucccccaggaguacauuagccaccuggcuucugaacaggccccaacuguuggggaggcugcccuucugcauuauguggauccugacaccggacgcaacuugggcgaguucaaggcauaccccgaugguuuucucacaugcguaccaaauggggccucaaguggcccgcagcaacugccuaucaacggagucuucguguuuguuagcugggugucccgauucuaccaguuaaagcccgucggcacugcuucuaccgcgagagggaggcugggacuacggcguuga

SEQ ID NO: 19245 - RNA, 1593 nt, Artificial Sequence
  derived and/or modified sequence opt3 from capsid_protein__Norovirus__ABW74123
augaugauggccagcaaggacgcuaccuccucuguggauggcgcaucaggggccggacagcugguccccgagguuaacgcgagugacccucucgcuauggauccaguggccgguagcuccacagcaguagccacugcuggccaagugaauccgaucgaccccuggauuauaaacaauuucguccaggcaccucagggggaauuuacgaucucuccaaacaauacccccggagaugugcuuuucgaccugucguugggcccucacuuaaacccauuucugcuacaucucucacagauguacaaugguuggguugggaacaugagagugaggauuaugcuggccggaaaugcuuucacagccggcaaaaucauugucagcugcauacccccuggcuuugggagucacaaccuuacuaucgcgcaagcaacccuguucccacaugugaucgccgauguacggacauuggacccgauugagguuccccucgaagaugugcgcaauguccuguuucacaacaaugaccgaaaccagcagaccaugcgucugguguguaugcucuauacuccuuuaagaacaggagguggcaccggggauuccuucguggucgcuggaaggguuaugacgugcccaucucccgacuuuaauuuccuguuucuugugccuccaacuguagagcagaagacccggcccuucacauugccgaaccugccucuaagcucccucucaaacagucgcgcaccccugccaaucagcggcauggguauuucuccugauaaugugcaauccguccaguuucagaacgggagauguacucuugacggaaggcuggugggcaccacacccguuucauugagccauguggccaaaauccggggcaccaguaaugggacggucauaaaccucacugaacuggacggaacaccauuccaccccuucgaggguccugcuccaauuggcuuuccggauuuagggggaugcgacuggcacaucaauaugacccaguucggccauucuucccaaacucaguacgauguggacacaacccccgauacguuuguaccucaccuggguagcauucaggccaacgggaucaauucgggcaacuauaucggaguucucucuuggguguccccacccucacauccuaguggcagccaagucgaccuuuggaagauuccaaauuacggguccucuauaaccgaggcgacacaccuggcccccagcguguucccgccuggauuuggugaagucuugguguucuuuaugucaaaaaucccaggccccggggcauauagucuaccuugucugcucccccaggaguacauuucccaccuggcuagcgaacaggccccaacuguuggagaggcugcccuucugcauuauguggauccugacaccggccgcaacuugggugaguucaaggcauaccccgauggguuucucacaugcguaccaaauggcgccucuucaggaccgcagcaacugccuaucaacggcgucuucguguuuguuaguugggugagccgauucuaccaguuaaagcccgucgggacugcuuccaccgcgagaggaaggcugggucuacggcguuga

SEQ ID NO: 19246 - RNA, 1593 nt, Artificial Sequence; identical to SEQ ID NO: 19245
  derived and/or modified sequence opt3 from capsid_protein__Norovirus__ABW74124

SEQ ID NO: 19247 - RNA, 1593 nt, Artificial Sequence; identical to SEQ ID NO: 19245
  derived and/or modified sequence opt3 from capsid_protein__Norovirus__ABW74125

SEQ ID NO: 19248 - RNA, 1593 nt, Artificial Sequence; identical to SEQ ID NO: 19245
  derived and/or modified sequence opt3 from capsid_protein__Norovirus__ABW74126

SEQ ID NO: 19249 - RNA, 1593 nt, Artificial Sequence; identical to SEQ ID NO: 19245
  derived and/or modified sequence opt3 from capsid_protein__Norovirus__ABW74127

SEQ ID NO: 19250 - RNA, 1593 nt, Artificial Sequence; identical to SEQ ID NO: 19245
  derived and/or modified sequence opt3 from capsid_protein__Norovirus__ABW74128

SEQ ID NO: 19251 - RNA, 1620 nt, Artificial Sequence
  derived and/or modified sequence opt3 from capsid_protein__Norovirus__ABW74532
augaagauggccagcuccgacgcuaaccccucugauggcucagcagccaaucuggugccugaggucaacaaugaaguuauggcgcucgagccagugguaggggcugccaucgcagccccgguggcuggacagcaaaacauuauagaccccuggaucagaaauaacuucguccaggcaccugguggcgaauuuaccgugaguccaaggaaugcccccggggagauucuuuggagcgcuccucugggaccagauuugaaccccuacuuaucccaccugucucggauguauaauggcuacgccgguggguucgaaguucaggugauccuagcgggaaacgcauuuacagccggcaaaauuaucuucgcugccgucccuccaaauuuuccgacugagggccucucgcccucacaggugacgauguucccucauguaauaguugacgugcgccaacuggagccaguccuuaucccccugccugaugugcgaaacaauuuuuaucacuacaaccaggcacaugacccaaccauuaaguugaucgcuaugcucuauacaccccugcgugccaauaacgcgggggaugacguguucacugucagcugcagaguucugaccaggccgaguccugauuuugacuucauuuuucucgugcccccaacaguagaaucccggaccaaaccuuucacugugcccaucuuaacagucgaggaaaugucuaacagccgcuuuccaauaccccuggagaaacuuuacaccggaccuuccucagauuucgugguucagccacagaaugguagauguacgacugacggcguguugcuggggaccacacaacuaagugccgucaacauuugcaauuucaagggagaugugacucacaucgcaggcagcagggacuaucggaugaaccucguaucucagaauuggaacaauuacgacccgaccgaggaaauucccgcuccucuggguacaccagauuuucaggggaagauccagggacuucugacccaaacgacuggcgccgacggcuccacacgcgcucauaaggccaccguuucaacuggggcagccaacuucacacccaaauugggaagcgugcaguuuaccacggauaccgacaaugauuuccagacaggucaaaacacuaaguuuaccccugucggcgugauccaggacgggagucaccaccagaaugagccacagcaauggguccuccccaacuacucuggacgaacagugcauaauguucaccuggcuccggcgguggcaccuacuuucccaggcgaacaguuacuguuuuucagauccaccaugcccgguuguagcggguauccuaacaugaaucucgauugccuucugccccaggaguggguaaugcauuuuuaccaggaagccgcuccagcccaaucggacgucgcauugcuaagguucgugaacccugauacaggccggguucuguuugaguguaaacuccacaaggccggauauauuaccguggcucacacuggccagcaugaccuggucauacccccaaacggguacuuccguuuugauucuugggugaaucaguucuauacgcuugccccgaugggaaacggugcaggccgcagaagggcgcuguga

SEQ ID NO: 19252 - RNA, 1620 nt, Artificial Sequence
  derived and/or modified sequence opt3 from capsid_protein__Norovirus__ABW74533
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucgugguucagccucagaaugguagauguacuaccgauggcguguugcuggggacaacucaacuaagugccgucaacauuugcaccuucaggggagacgugacacauaucgcaggcagccacgauuauaccaugaaucucgcuucucagaacuggaauaacuacgacccaacggaggaaauuccggcuccccuggguacuccugacuuuguagggaagauccagggaaugcuuacacagaccacucggggcgauggcuccacacgcgcccauaaggccaccguuucaacggggagcgugcacuucaccccaaagcugggaaguguccaauuuacaacugacaccaauaacgauuuccagacaggucagaauacuaaauuuacccccgugggcgucauccaagacggggauaaccaccagaaugagccucagcaguggguguugccaaacuacucuggacgaacaggccauaauguucaccucgcacccgccguggcuccgaccuucccuggugaacaacuguuauuuuucagauccacuaugccaggguguagcggcuaucccaacaugaaccuggacugccuccuuccucaggaguggguacagcauuuuuaccaggaagcggcacccgcccaaucggaugucgcucuguugagguucgugaauccagacacgggacggguucuauuugaguguaagcugcacaaaucuggcuaugugacagucgcccacaccgggccucaugaucucgugauucccccaaacggauacuuccguuuugacuccuggguaaaucaguucuauacucuggcaccgauggguaacggcaccgggcgcagaagggcccuuuga

SEQ ID NO: 19253 - RNA, 1623 nt, Artificial Sequence
  derived and/or modified sequence opt3 from capsid_protein__Norovirus__ABW74534
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacucgcccuuucacagugcccaucuuaaccgucgaggaaaugacuaauucuagauuuccaauaccccuggagaaacuuuucacgggaccuagcggugcguucgugguucagccacagaacgggagguguaccacagauggcguguugcugggaacuacccaacuauccccggucaauauuugcacauuucggggcgacgugacccauaucgccgguacgcacgauuacacuaugaaccucgcaucacagaauuggaacaauuaugaccccacagaggaaauuccugcuccacuggggacccccgacuucguaggaaagauccagggcguucuuagucagacuacacgcggcgaugggagcacccgaggacauaaagccacggugucuaccgguuccguccacuuuacaccuaagcugggcucagugcaauucacuaccgacacaaacaaugauuuggagacugggcagaacaccaaguuuacaccagucggagugguucaggacggcaauagcacccaccaaaacgaaccccagcagugggugcucccgaauuacagugguagaacugggcauaacguacaccuggcuccugccgucgcaccaacguuccccggcgagcaguuacuguuuuucaggucuacaaugccuggauguuccggcuaccccaauaugaaccucgauugccuucugccacaagaaugggugcagcauuuuuaucaggaggccgcuccugcgcagagcgacguugcauugcuacgguucgugaaccccgauaccgggcguguccuguuugaguguaaacuccacaagucgggauacgugacuguagcccacaccggucaacaugaccuggugaucccaccgaauggcuauuuccgcuuugauucuuggguuaaccaguucuacacacuugcuccuauggggaauggagccggcagaaggcgggcacuguga

SEQ ID NO: 19254 - RNA, 1623 nt, Artificial Sequence; identical to SEQ ID NO: 19144
  derived and/or modified sequence opt3 from capsid_protein__Norovirus__ABW74535

SEQ ID NO: 19255 - RNA, 1620 nt, Artificial Sequence
  derived and/or modified sequence opt3 from capsid_protein__Norovirus__ABW74536
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcagacuauucuagcgggaaacgcauuuacggccggcaaaaucauuuucgcugccgucccuccaaauuuuccgaccgagggccucucucccucacaggugacaauguucccucauaucauaguagacguucgccaacuggagccagugcuuaucccccugccugauguccgaaacaauuuuuaucacuacaaccagucgaaugacccaacuauuaaguugaucgcaaugcucuauacaccccugcgugcuaacaacgccggggaugacguguucaccgugagcugcagaguccugaccaggccgaguccugauuuugacuucauuuuucucguucccccaacuguggaaucccggacaaaaccuuucaccguacccaucuuaacgguggaggaaaugucuaauagccgcuuuccaauaccccuggagaaacuuuacacuggaccuuccucagcguucgucgugcagccacagaacgguagauguaccacagauggcguuuugcuggggacuacccaacuaagugccgugaauauuugcacauucaggggagacgucacccauaucgcaggcagccacgauuauacgaugaaccucgcuucucagaauuggaacaauuacgacccgacugaggaaauucccgccccucuggguacaccagacuuuguggggaagauccagggaaugcuuacccagacuacacgggaggauggcuccacccgcgcucauaaggccacgguaucaaccggcagcguucacuucacacccaagcuggggagugugcaauacacuaccgacacaaacaaugauuuucaggcaggacagaacacuaaauucaccccugucggugugauccaagacggcaauaaccaccagaaugaaccacagcagugggucuugcccaacuauucugggcgaacaggacauaaugugcaccucgccccggcuguugcgccuaccuuuccaggcgagcaacuguuauucuuuagauccacuaugcccgguuguagcggguacccuaacaugaaccuggauugccuccuuccccaggaaugggugcagcauuucuaucaggaggcagccccagcucaaucggacguagcccuguugagguuugucaauccugauacgggccgggugcuauucgaguguaagcugcacaaaucuggauacguuacaguggcacacaccggcccccaugaccucgucauuccaccgaacggguauuuucguuucgauuccugggugaaucaguuuuacacucuggccccuaugggaaacgguaccggccgcagaagggcucuuuga

SEQ ID NO: 19256 - RNA, 1623 nt, Artificial Sequence
  derived and/or modified sequence opt3 from capsid_protein__Norovirus__ABW74537
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucacagugcccaucuuaaccgucgaggaaaugacuaauucucgcuuuccaauaccccuggagaaacuuuucacgggaccuagcuccgcguucgugguucagccacagaacgguagauguaccacagauggcguguugcuggggacuacccaacuaucaccggucaauauuugcacauuuaggggagacgugacccauauccccggcacgcggacuuaccgcaugaaccucgccagucagaauuggaacaauuaugauccuacagaggaaauuccagcaccccuggguaccccugacuucguagggaagauccagggaaugcuuacucagacaaccaagggcgacggcagcacgcgagggcacaaggcuaccguuucuacaggauccguggauuuuacuccaaaacuggguucaguccaauucgccaccgacacagauaacgacuuugagacuggccagaauaccagauucacacccgugggggucauccaggauggaagcagugcucauaggaacgaaccgcaacaguggguguugccugacuacucuggccggaccguucacaaugugcaccucgccccagcaguagcccccacuuuuccuggugagcagcuguuauucuuucguuccacgaugcccggguguagcggcuacccaaacauggaucuggacugccuccuuccucaggaauggguccaacauuucuaucaggaggcugcgcccgcacagucggauguggcccuguugcgcuuuguuaauccagacacaggaagagugcuauucgaguguaagcugcacaaaaccggcuacgucacuguggcucauaccgggcagcacgaucucguaauuccgccuaacggauauuuuagguucgacucuugggugaaucaauucuacacacuggcccccauggguaacggcgcagggcggcgacgcgcccuuuga

SEQ ID NO: 19257 - RNA, 1623 nt, Artificial Sequence
  derived and/or modified sequence opt3 from capsid_protein__Norovirus__ABW74538
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaguaauuucgugcaggcuccugguggcgaauuuacaguuagcccaaggaacgcacccggggagauccuuugguccgccccucugggaccagauuugaaucccuacuuaucucaccuggcucggauguauaacggcuacgccgguggguucgaagugcaggucauucuagcgggaaaugcauuuacugccggcaaaaucauuuucgcugccgugccuccaaacuuuccgacggagggccucucgcccucacagguaaccauguucccucauaucauaguugacgugcgccaacuggagccaguccuuaucccccugccugaugugcgaaauaacuuuuaucacuacaaucaguugaacgacccaacaauuaagcucaucgcaaugcuguauacuccccugcgugcuaauaacgccggggaugacguguucaccgucagcugcagaguucucacaaggccgaguccugauuuugacuucaucuuuuuagugcccccaaccguagaaucccggacuaaaccuuucacagugcccauucugaccgucgaggaaaugacgaacucucgcuuuccaauaccccuugagaaguuguucacuggaccuagcggugcguucgugguucagccacagaauggcagauguaccacagauggggugcugcuaggaacuacccaacucuccccggucaacauuugcacauuuaggggcgacgugacccauaucgccgguacgcacgauuacacuaugaaucuggcaucacagaacuggaauaacuaugaccccacagaggaaauuccugcuccacuugggacccccgacuucguaggaaaaauccagggcguucugacucagacaacccggggcgaugggaguacgcgcggacauaaggccaccgugagcacagguucuguccacuuuacuccuaaguugggcuccgugcaauucaccacagacacuaauaacgaucucgagaccgggcagaauacacgauuuaccccagucggagugguucaggacggcaacucaacucaccaaaaugaaccccagcagugggugcugccgaacuacagcgguagagcugggcauaauguacacuuagccccugcagucgccccaacguuccccggcgagcagcugcucuuuuucaggaguacaaugccuggauguucuggcuaccccaacaugaaucuugauugccuguugccacaagaaugggugcagcauuuuuaucaggaggcugcgccugcacaguccgacguugcccuacugcgguucgugaaccccgauaccgggcguguccucuuugaguguaaacugcacaagagcggauacgugacuguagcucacaccggucaacaugaccuugugaucccaccgaacggcuauuuccgcuuugauucguggguuaaucaguucuacacacuggccccuauggggaacggagcaggcagaaggcgggccuuguga

SEQ ID NO: 19258 - RNA, 1623 nt, Artificial Sequence
  derived and/or modified sequence opt3 from capsid_protein__Norovirus__ABW74539
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugacgaacucucgcuuucccauaccacuggagaaacuuuucacuggacccagcggugcguucgugguucagccucagaauggcagauguaccacagaugggguguugcugggaacuacccaacuauccccagucaacauuugcacauuuaggggcgacgugacccauaucgccgguacgcggaauuacacuaugaaccucgcaucacagaauuggaacaauuaugauccgacagaggaaauucccgcuccucuggggaccccagacuucguaggacgcauccagggcaugcuuacucagacaacccgaagagacggcaguacgagggggcacaaggccaccguuagcacaggagaugcucauuuuacucccaagcuggguucuaucauguucuccaccgacacagauaacgacuuugagacuggccaaaauaccaaguucacaccugugggggucgugcaggauggaaacggcacccaccagaaugaaccacaacagugggucuugcccucauacagcggucggacugggcacaacgugcaucucgccccggcaguugccccuacguuuccaggcgagcagcuguuauucuuucguaguacaaugcccggauguucuggcuacccuaauaugaaccuggacugccuccuuccccaggaaugggugcaacacuucuaucaggaggcugcgccagcacaguccgauguagcccuguugcgcuuugucaacccugacaccgggagagugcuauucgaguguaaacugcauaagagcggauacguuacuguggcucacaccggucagcacgaucucgucauucccccaaauggcuauuuuagguucgacucgugggugaaccaauucuacacacuggccccgauggggaauggaaccggccggcgacgcgcacuuuga

SEQ ID NO: 19259 - RNA, 1623 nt, Artificial Sequence; identical to SEQ ID NO: 18127
  derived and/or modified sequence opt3 from capsid_protein__Norovirus__ABW74540

SEQ ID NO: 19260 - RNA, 1623 nt, Artificial Sequence
  derived and/or modified sequence opt3 from capsid_protein__Norovirus__ABW74541
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccucauucgugguucagccacagaacgguagauguaccacagauggcguguugcuggggacuacccaacuaaguccggucaauauuugcacauuuaggggagacgugacccauaucgcgggcacgcagaacuacacuaugaaucucgccagccagaacuggaauaacuaugaucccacagaggaaauuccugcaccacuggguacccccgacuucguagggaagauccagggaguucuuacucaaacaacccggggcgacggcucuacgcgcgggcacaaggcuaccguguccacaggaucaguccauuuuacuccuaagcuggguagcgugcaguucaguaccgauacaucuaaugacuuugagacuggccagaacacccgauucacaccagucggggugguucaagauggauccaccacucaccagaaugaaccccagcaguggguguugccggacuacagcggcagaaacucgcacaauguacaucucgccccugcugucgccccaacguuucccggugagcaacuguuauucuuuaggucuacaaugccuggguguuccggcuaccccaacaugaaucuggauugccuccuuccacaggaaugggugcagcacuucuaucaggagucagccccugcacaaagugacguugcucuguugcgguuugugaaccccgauaccggacguguccuauucgaguguaaacugcauaagagcggcuacgugacuguagcgcacaccgggcagcacgaccucgugaucccaccgaacggauauuuucgcuucgauuccuggguuaaucaguucuacacacuggcaccuauggguaacggcgccgggagaaggcgggcucuuuga

SEQ ID NO: 19261 - RNA, 1623 nt, Artificial Sequence
  derived and/or modified sequence opt3 from capsid_protein__Norovirus__ABW74542
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucucugugccuaucuuaacugucgaagagaugacaaacagccgcuuucccauaccacuggagaaacuuuucaccggacccuccucagccuucgugguucagccucagaaugguagauguacgacugacggcguguugcuggggaccacacaacuaaguccagucaacauuugcacuuuuaggggagaugugacccauaucgcaggcacacaggaauacaccaugaaucucgcuagccagaacuggaauaacuaugacccgacggaggaaauucccgccccucuggguacuccagauuucguagggaagauccagggaguucuuacacaaaccacucggcgcgacggcucuacacgaggccacaaggcuaccguguccacggggucaguccauuuuacccccaagcugggaagaauccaguucagcacagacaccaguaaugauuuugagacuggucagaacacaagguucacuccugugggcgucgugcaagacgggucuaccacacaccagaaugaaccacagcaguggguuuugcccaacuacuccggacgggauagccacaaugugcaucucgccccggcaguagccccuucguuuccaggcgagcaacuguuauucuuucguucuaccaugcccgguuguuccggguacccuaacauggaccuggauugccuccuuccccaggaguggguccagcacuucuaucaggaagcugcgccagcacaaucagacguggcccuguugcgcuuuguuaauccugauacuggcagagugcuauucgaguguaaacugcauaagaguggauacgucacgguggcucacacaggccagcacgaccucguaauucccccaaacggguauuuuagguucgauagcugggugaaccaguucuacacccuggccccgaugggaaaugguacuggccggcgacgcgcacuuuga

SEQ ID NO: 19262 - RNA, 1623 nt, Artificial Sequence; identical to SEQ ID NO: 18112
  derived and/or modified sequence opt3 from capsid_protein__Norovirus__ABW74544

SEQ ID NO: 19263 - RNA, 1623 nt, Artificial Sequence; identical to SEQ ID NO: 18675
  derived and/or modified sequence opt3 from capsid_protein__Norovirus__ABW74545

SEQ ID NO: 19264 - RNA, 1623 nt, Artificial Sequence
  derived and/or modified sequence opt3 from capsid_protein__Norovirus__ABW74546
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggaguaccacacaccgaaacgaaccccagcaaugggugcucccgucuuacuccggaagaaauguucacaacgugcaucuggccccugcaguagcuccaaccuuucccggcgagcaguuacuguucuuuaggagcacuaugccugguuguucgggguaucccaauauggaucucgacugccuucugccacaggaguggguccagcacuuccaucaagaagcggccccugcacagucugauguggcuuugcuacgguuuguuaaccccgacacgggccgugugcuguucgaguguaaacuccacaaguccggauacgucacaguggcccacaccggccagcaugaucugguaauuccaccgaacggguauuuucgcuucgacucaugggugaaucaguucuacacucuugcaccuaugggaaacgguaccggcagaaggcgggcccuguga

SEQ ID NO: 19265 - RNA, 1566 nt, Artificial Sequence
  derived and/or modified sequence opt3 from capsid_protein__Norovirus__ABW75843
augaagaugagcgacaaagaguccgccgaaucucccgcuucacugggccaggugcucccuccacaagucgauguugugguaccgguggagcccaccgucggggcacagaucgccgcgccuacagcuggacagauuaacccaauagaccccuggaucuucaguaauuuugugcaggccccucaaggugaguucacuauuagcccaaacaauaaccccggcgaaauccuuuuugaaauggagcuggggccugauuugaauccauacuuaggacaccugagaaggauguauaacggcuggacggguucccuacggguucgcgugaugcucgcagggaaugccuucucugcuggaaagauuaucgucuuuugcauaccgcccggcuucgacaccacauuucugacuccugcacaggccacccaguucccacaugugaucauggauguacgagcucccgacccuguugaggugccacuugaagauguccguaacgugcuguuucaccagggccccgacaauagaaugagguugguggggaugcucuacacaccgcugcgggccaacucgggagcggauccuuucgucguuaccggucgcgugcugacuugucccucagagaauuuuagcuucuuuuuccucguaccaccuacaguggaagagaaagacguccccuucaccauuccaaacgugcccacgaguuccuuaacuaauucuagaaugcuggagccuguugcagaacuuaggagcucccggaacuuugccuugucagugcaauuccagaauggccgcaguaccaucgagggggaacugcuaggaacaacuccagcuagccucgccgaucugggcucuuuucuuugcauucgaggugggaccgcaaaccuggcugaguuguuccagccgaacgaagacgccuuugucgcgggaucccaucccgccccuuucggcuuuccagauuucucaaauuguacacucgacuuucuguuauaugacgcaaacggccuguaccacagacaucucgaugugaccagcgcuaguaauuucacgcccgcccuugggcacaucacucuggacggaucuguaccugauagguugacacgggcucgucuagaggguguucagcgcgccuccgagaacaccuuuuggagaaugccagacuauaggggcgaugugcugggggcagaguucgcccccgcugucagcgcgccgggaauaggcgaaacucuccuguuuuucaugucgaaugugccuuaccacaacgguucuaauccaaacccccuuccuugccuguugccccucgaauggauuaaucauuucgucgcagagcggccagccaagcaauccgacguggcucuguuaaacuauaucaauccucugacagggcgaguucuauuugaauguaaacucuacucagccggcuuccuggcagugaaccuuggaagucagaccgagguaacguugcccgucgauggcauuuuuaaguucgugagcuggguuuccuacuauuaccagcugcgcccaguggggaccgucucugugggaagaaggcucccgcggcuggacggucacuga

SEQ ID NO: 19266 - RNA, 1737 nt, Artificial Sequence
  derived and/or modified sequence opt3 from capsid_protein__Norovirus__ABX71062
augaagauggccagcaacgacgcugcacccuccucugauggcgccgggaaucuggugccugagucacaccaggaaguccucccacuugcgccgguugcuggagccgcaaucgccgcucccgugguaggucaacagaacauuauagacccuuggaucaaagagaauuucgugcaggcaccacagggcgaauuuaccgucagucccaagaacagcccuggggaggugcugguuaauuuggaauuauccccaaaacugaaccccuaccuagaucaucucucuaagauguauaaugccuacgcuggaggcauggagauugagaucauucuggccgguaacgcguucacagcagggaaagugcuuaucgccgcugucccuccaaauuuuccgguggaaaacauaucgguaucacaagccagccaguucccccacguuaucguggacgucagaacucuggagccuauuagguugccacuccccgaugugcggacgaacuuuuuccauuauaccacacgcgacgaaccuaagaugcgaaucguggcauggcuguacacuccacugcguaccaauggaaguggcgaugacuccuuuacagucucuggcaggauucucaccagacccagcgcugauuucgaguuuuccuucuuaguuccgccuacuguggagacaaagaccguaucauuuagugugcccgggcugacggucgaagagaugagcaauucucgguggccagcccagaucaacggacuugugguucgcgguaaugaagcacaggugguccacuuccaaaacggcagaugcacuaccgaggggauguugcugggaacaacuacccuaaacguaaauuccauauguggccucagggguacaucaauuagccaugccagugugcgggaagcgccugcucugucugaggagaugcccccacuugaagacgagguugcccacggggcugccgcaaccuaugccgugggacgcgcugcggauacgacucuguggauccgagucgaggaacccaacggccagccuuacgacauuuuuggcgaacagccagcaccguuggggacacccgauuucaccgccgugaucaucggaacugcuauuagaccuaggacagccuccggugcauaucuccacgacgccuacgucgacacccggccaggcgaugcugacuucacgcccagcaccgggaauacaaaaauagugcugcguggaggcgguucggggcauguuggcgagggacacuacuggcaguuuaagccuaucgccguggagggcgggccaaaccgccccguauaucaagaauacaauuuaccggaguaugcaggaccuacugcgucuaaccauaaucuggcuccacccgucgccccuaaaaugcccggugaacuccuucuguuguucgaguccgauaugccagugugggacaacggcucagggagugcaccuacccagaagauucacugccuacugcccaaugauuuuguuacacacuucuuugaccuccaggccccagcucuggccgaagcagcccuucugagauacgugcauccggauagcggaaggacuuuguucgaguguaaacucuaucgggagggcuacauggucgugguagcuccuuccggucgacuggacuuucccuuagauggguauuuccgcuuugacucuugggugaacgcguucuacguucugagcccagucggcaauggacaaggcagaagggggcgggccaagaacaucuga

SEQ ID NO: 19267 - RNA, 1605 nt, Artificial Sequence
  derived and/or modified sequence opt3 from capsid_protein__Norovirus__ABY77754
augaagauggccagcaacgacgcuucccccucuucagauggcagugcaaaucuggugccugagaucaacaaugaagucauggcccucgagccaguugcgggggcugccauugcagccccgguggcuggacagcaaaacauaaucgaccccuggauuagaaauaacuucguacaggcaccugguggcgaauuuaccgugagcccaaggaaugcccccggggagguccuucugaacuugccuuuauccccagauaucaaucccuaccuggcucaccuaucucggauguauaacggauacgccggcgguguggaaguugaggugguccucgcggggaaugcauucacagccggaaaaauuaucuuugcugccgugccuccaaacuucccgcccgagaaucugucgccuucacagauaacuaugcuuccacauaucauuguagacguucgccagcuggaacccgugcgaaucccuuugccagauguccguaacaauuuuuaucacuacagcagagagaacgacaguacgcucaggcugguggcaaugcuguauaccccucuccgggcuaacaaugccggcgaugacguguucacagucuccugccgcguuuuaacuagaccgucuccugauuuugacuucauuuuucuggugcccccaaccguagaaagcaaguccaaaccuuucacaauccccauacuuaccauugaggagaugacuaacucaagguuuccagcgcccuuggaaaugaugacaaccggcccuagucaugauaucgugguccaaccacagaaugggcgguguacgauugacggagugcugcuagguacuacccagcucagcccgguuaacaucugcucuaugcgcggcgugcccacaaagcgaacuaaugggaccgauaacuguuucguccagcuggagaauccuaacggauccgccuacgacccaacagaagacauccccgcagugcuuggcucaccugauuuuguaggugaguucuaugggaccauuacgcaaagaagcccaaauaacaguacuagggcucaccccuucacacugaauaccggaucuccgcgguacacuccuaaaauaggcuccguugacauccaugugacagaugucgacgauuugaacgaccacgaaccagugaagcucacccccgucggccugagcgggucgucuggauccauucaccaguggcaguuaccuaauuacucagguguggccacgcauaacaugcaccuggcucccaguguugccccacucuuuccuggcgagcagauccuuuucuuucguagcaccgugcccgggugcggaggcuauccaaauacaaacauagauugucugauuccgcaagaguggguacagcauuucuaccaggaaggugcacccgcccgcacugacgucgcuuugcuaagauuuaucaaccccgauaccgggagggugcuguucgagugcaagcuccacaaacacggcuuuaucacaguugcguauuccggaaaucaugaccuggugaugccacccaacggcuacuuccgguuugaaucuugggucaaucaauuccacacucuugcaccuauggggaccggacgagccgaggaaauucaguga

SEQ ID NO: 19268 - RNA, 1608 nt, Artificial Sequence
  derived and/or modified sequence opt3 from capsid_protein__Norovirus__ABZ89549
augaagauggccagcaacgacgcuucccccucuucagauggcagugcaaaucuggugccugagaucaacaaugaagucauggcccucgagccaguugcgggggcugccauugcagccccgguggcuggacagcaaaacauaaucgaccccuggauuagaaauaacuucguacaggcaccugguggcgaauuuaccgugagcccaagaaaugcccccggggagguccuucugaacuugccuuuauccccagauaucaaucccuaccuggcucaccuaucucggauguauaacggauacgccggcgguguggaaguugaggugguccucgcggggaaugcauucacagccggaaaaauuaucuuugcugccgugccuccaaacuucccgcccgagaaucugucgccuucacagauaacuaugcuuccacauaucauuguagacguucgccagcuggaacccgugcgaaucccuuugccagauguccguaacaauuuuuaucacuacagcagagagaacgacaguacgcucaggcugauugcaaugcuguauaccccucuccgggcuaacaaugccggcgaugacguguucacaguguccugccgcgucuuaacuagaccgucuccugauuuugacuucaucuuucugguucccccaaccguggaaagcaaguccaaaccuuucacaauacccauucuuaccaucgaggagaugacuaacucaagguuuccagcgcccuuggaaaugaugacaaccggcccuagucaugauauuguagugcaaccacagaaugggcgguguacgaucgacggaguccugcuagguacuacccagcucagcccggugaacaucugcucuaugcgcggcguucccacaaagcgaacuaaugggaccgauaacuguuucgugcagcuggagaauccuaacggauccgccuacgacccaacagaagacauucccgcaguccuuggcucaccugauuuugugggugaguucuaugggaccauaacgcaaagaagcccaaauaacaguacuagggcucaccccuucacacugaauaccggaucuccgcgguacacuccuaaaaucggcuccguagacauucauguuacagauguggaagacuugaacgaucacgagccagucaagcucacccccgugggccugagcgggucgucuggauccauccaccaguggcaguuaccuaauuacucaggugucgccacgcauaacaugcaccuggcucccaguguggccccacucuuuccuggcgagcagauacuuuucuuucguagcaccguucccgggugcggaggcuauccaaauacaaacauugacugucugaucccgcaagaaugggugcagcauuucuaccaggagggugcacccgcccgcacugauguagcuuugcuaagauuugucaaccccgacaccgggagggugcuguucgaaugcaagcuccacaaacacggcuuuaucacaguugcguauuccggaaaucaugaucuggugaugccacccaacggcuacuuccgguuugagucuugggucaaucaauuccacacucuugcaccuauggggaccggaagcggucgacgcaggauucaguga

SEQ ID NO: 19269 - RNA, 1644 nt, Artificial Sequence
  derived and/or modified sequence opt3 from capsid_protein__Norovirus__ACC69023
augaagauggccagcaacgacgcucccccuuccaccgauggcucugcagggcuggugccagaggucaauaacgaaacaauggcccucgagccgguugugggagcgccccuugcugccccuguagcaggucagcacaauaucauugacccauggauaaaaaugaacuucgugcaagcccccaauggcgaauuuacugucucaccuagaaacgcuccaggggagauccuguuggauuuagaacugggacccgaccuaaauccuuaccucagucaucuggcaaggauguauaacggcuacgccggugggauggaggcucaggugguucuugccggaaaugcguucacggcaggcaagauuaucuuugccgcugugccaccgaacuuccccgccgagaaucugagcgcagcucaggucaccaugugcccucacgugauuguagauguucggcaguuggaaccagugaugcuccccaugccugacauccgcaacaaacuguuucauuauaaucaagucgaugacccaaagcugcgacucuuagccuaccuguauacaccccuucgugcgaacaaugccggcgaugacguguucacuguguccuguagagucuugaccaggccgacaccugauuuugaguucauguuucugguucccccaaccguggaaucuaaaacuaagccuuucucgcuacccgggcucacacuggacgagcuuucaaacagccgguuuccagcacccauaguacagcuguacaccaacccucacgauaauuuggugguccagccacagaacggacgcugcacgaucgacggucuccugcaaggcacuacccaguuagugaguuguaauguuugcuccuauagagggacaauuggaggcggucagccggcuucucauacugaggaagagaucaugcccauggccuucaacauucagagggaaaucaugcuggagaaucucgacgggagcccuuacgauccaguggacgauauacccgcuguccuuggauccccugacuuucaaggcgugguauucggcauucugucacagcggaacgccaaugggcagacccgcgcacacgaagccaagguugauacacgagcugcgagauucgcaccaaaauugggauuuguggucgccaccguggagaguacggacuuccacgauaaccaacccagcagguuugcuccggucggucuaggcgggaauggaaaccaggacuucaaucagugggcccugccugcauacggcggugcccucacuaacaauacaaaccuggcuccacccgugaugccuguuuaucccggggagcagcuucuguuuuuccggucucaauugccauccucaggcggagugguaggcggguggcucgauugucuguuaccucaggaauggguccagcacuuuuuccaggagagcgccaccagucaaucugacguggcacugguucguuacaucaaucccacuacaggacgcgugcuauuugaagcgaagcuccauaaacaggguuuccugaccgucgcugccuccggcagcuauccacuugugguaccggcagauggguacuuuagauucgagucgugggugaaccaguuuuauacguuggccccuaugggaaacggcucugguaggcggcgagcucgcuga

SEQ ID NO: 19270 - RNA, 1644 nt, Artificial Sequence
  derived and/or modified sequence opt3 from capsid_protein__Norovirus__ACC69026
augaagauggccagcaacgacgcucccccuuccaccgauggcucugcagggcuggugccagaggucaauaacgaaacaauggcccucgagccgguugugggagcgccccuugcugccccuguagcaggucagcacaauaucauugacccauggauaaaaaugaacuucgugcaagcccccaauggcgaauuuacugucucaccuagaaacgcuccaggggagauccuguuggauuuagaacugggacccgaccuaaauccuuaccucagucaucuggcaaggauguauaacggcuacgccggugggauggaggugcagguugugcuugcuggaaaugccuucacggcgggcaagauuaucuuugcagccgucccaccgaacuuccccgcugagaaucugagcgccgcacaggugaccaugugcccucacguaauuguugaugugcggcaguuggaaccagucaugcuccccaugccugacauccgcaacaaacuguuucauuauaaucaaguggaugacccaaagcugcgacucuuagcuuaccuguauacaccccuucgugccaacaaugcgggcgaugacguguucacugucuccuguagaguuuugaccaggccgacaccugauuuugaguucauguuucuggugcccccaaccguagaaucuaaaacuaagccuuucucgcuacccgggcucacacuggacgagcuuucaaacagccgguuuccagcccccauagugcagcuguacaccaacccucacgauaauuuggucgugcagccacagaacggacgcugcacgaucgacggucuccugcaaggcacuacccaguuaguuaguuguaaugugugcuccuucagagggacaauuggaggcggucagccggcaucucauagcgaggaagagaucaugcccauggcuuuuaacauucagagggaaaucaugcuggagaaucucgacggguccccuuaugauccagccgacgauauacccgcuguccuuggaucaccugacuuccaaggcgugguauucggcauucugagucagcggaacgccagcgggcagacucgcgcacacgaagccaagguugauacccgagcugcgagauuugcaccaaaauugggauucguggucgccacaguggagucuaccgacuuucacgauaaucaacccuccagguucacgccggucggucuaggcgggaacggaaaucaggacuuuaaccagugggcucugccugccuacggcggugcacucacuaauaacacaaaucuggccccacccgugaugccuguuuaccccggggagcagcuucuguucuuucggucacaauugccaagcaguggcggagugguaggcggguggcucgauugucuguuaccucaggaauggguccagcauuucuuucaggagucugcuaccucccaaagcgacguggcccugguucguuauaucaaccccacuacaggacgcgugcuauucgaagcaaagcuccacaaacaggguuuucugaccgucgcggcuucgggcucuuacccacuugugguaccggccgauggguauuucagauuugaguccugggugaaucaguucuacacguuggcaccuaugggaaacggcucagguaggcggcgagcccgcuga

SEQ ID NO: 19271 - RNA, 1671 nt, Artificial Sequence
  derived and/or modified sequence opt3 from capsid_protein__Norovirus__ACC69028
augaagauggccagcaacgacguggcugcacccuccaccgauggcucugccgggcuggucccugagguuaauaacgaaacaauggcgcucgagccaguggcuggagccgcacuugccgcuccgguagugggucagcacaaugucaucgaccccuggauuagaggcaacuucgugcaagcaccuaauggggaauuuacuguuucaccaaggaacagucccggagaggugcuguugaauuuagaacugggcccugagcuaaacccauaccucgcccaucuggcucggauguauaaugguuacgccgggggaauggagguccaggugguacuugcgggcaacgcauucgccgcuggcaaaauaaucuuugccgcaguucccccuagcuucccaguggaugcucuguccgccccgacgauuaccaugugcccccacgucaucguggacgugcgccaguuggaaccuguccuccugccaaugcccgauguucgaaauaacuuuuuccauuauaaucagucuucggacccuaagcugcgucucguggcgauguuauacacaccacugagagccaacucacccacugaugacguauuuaccgugagcuguaggguccuuacacggccgaguccugauuucgaguuuaccuucuugauucccccaacuguggaauccaaaucuaagccucugacaaucccccaacuaacccucagcgagcuguccaauucacgcuuuccagcacccauagacaugcuuaacacgaguccuaacgauaauaucguugugcagccacagaacgggagaugcacucuggacggagaguugcaggguaccacacaacuccagccgagccugauuuguucuuucaggggcgucguguuaaaugaaacuucccggauggcuguagauuaugaggaagaggaagagguucagcgcccccaggcccgagcuuuuaaccacgaguaccaucugcaacuccagaaucuugacgggaccgacuaugauccugccggagaccugccagcaacauugggcgcccccgauuucguggguaccgucuacgggguggucucacagagaacgacuagggacagcgcugcgcgggcacacgaagccaaaaucauuacaaacgauccucguuacgcuccaaagcuaggaaguguggaguucguuaccgaaucuacugacaucgugauaaaugaucaaacaaaguuuacccccguaggccuggcccacaaccgcgcagucgacuauaaacagugggagcucccgcauuacgccggcgaacugacggcuaauaccaaccuugccccuccaguggcacccguuuauccuggggagcagcuguuguucuuuagauccaaucucccccuggcgggagguacagcugccagcguguuagauuaccugcuaccacaggaguggauucaacacuucuaucaggaaucguuuacuccucagucugacaucgcacuccugagguacgucaaccccgauaccggccgggugcuuuucgaggccaaguugcaucgacagggguauauuacaguagcuggagccggcacuuccccaguggcaguuccgccuaaugguuacuuucgcuucgaaucaugggucagucaauuuuacgcucuggcccccauggggagcggcaccggaagaaggcggaaccaguga

SEQ ID NO: 19272 - RNA, 1626 nt, Artificial Sequence
  derived and/or modified sequence opt3 from capsid_protein__Norovirus__ACC96732
augggcaugagcgacggggccgcucccaaggcaaacggauccgaggccucuggucaggaucuggugccuaccgcggucgaacaagcuguuccaauccagccgguggccggcgcagcccucgcugcacccgccgcugggcagauuaaucagauagacccuuggaucuuccaaaacuuuguacagugcccacuuggagaguucucaauuagucccagaaauacaccuggcgaaauccuguuugauuuggccuuagguccagggcugaaccccuaccuagcgcaccucagcgcaauguauacuggaugggugggcaauauggagguccagcuggugcuugccggcaacgcuuucacggccgggaaaguuguggucgcacuggugccuccauacuuuccgaagggauccuugaccacagcucagauuacuuguuucccccauguaaugugcgacguuaggacccucgaaccuauccaacugccacugcucgaugugcggcgcgucuuauggcacgccacacaggaccaggaggagucuaugcgacugguguguaugcuuuauacccccuugcguacuaauucgccuggugaugaaucauuuguggucagcggcagacugcuaaguaaaccagcggccgacuucaacuuuguuuaccucacacccccgauagagaggaccaucuaucggaugguggaucugccuguaauucagccccgccuuugcacgagagcaagguggccagcuccuguguacgggcuguuggucgaccccucccucccaucuaauccccaauggcagaacggacgggugcauguugauggcacucuguuagguaccacaccuaucagcggguccugggugucauguuucgccgcugaagccgcauaugaguuucgcaguggaacuggcgaggaagucaccuucacacugauugagcaggacggcagcgccuacgugccaggggaucgagcugcgccgcucggauaccccgacuuuucuggucaacuugaaaucgagguacagaccgaaacgacuaagacaggcgacaaacugaagguuaccacuuucgagaugauauuggggccuagaacaaauguggaucaggcaccauaucagggaagggccuacgcuuccgucaacgccaccgcaucacuaaaucugguggacggccggguccgugccgugccccgcagcauucacaguuuccaagauguuaucccugaguauaacgacggucuccuggugccacuugcucccccgauugggccuuuucugccaucugaaguauugcucagauucaggacguacaugcggcagaucgauaccgccgacgcagcggcugaggccaucgauugcgcacugccccaggaauuugucuccugguucgccagcaaugcuuuuacagugcagucggaggccuuacugcuacgauaucgcaacacucucaccggccaacugcuuuucgaauguaaguuguacucugagggauauauugcacuguccuacucaggcagugggccucucacauuucccacugacggauucuuugagguugugagcugggucccaagacuguaccagcuugcuuccguggguucucuggccaccggcaggacauugaaacaguga

SEQ ID NO: 19273 - RNA, 1626 nt, Artificial Sequence
  derived and/or modified sequence opt3 from capsid_protein__Norovirus__ACC96735
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgcggggguccuugaccacaacucagauuaccuguuucccccauguaaugugcgacguucgcacacucgaaccuauccaacugccacugcucgaugugcgacgugucuuauggcacgcuacccaggaccaggaggagucuaugagacugguguguaugcuuuauacucccuugaggacaaauucgccuggagaugaaucauuuguggucagcggucggcugcuaaguaagccagccgcggacuucaacuuuguuuaccucacgcccccgauagagcgcaccaucuauagaaugguggaucugccuguagugcagcccaggcuuugcacucaugcccgguggccagcaccuauuuacggccuguuggucgaccccucccucccaucuaauccccaauggcagaacgggcgcgugcacguugauggaacccuguuaggcacaacuccuaucagcgguuccugggugucauguuucgcugccgaagcugccuaugaguuucagagugggaccggagaggucgcaacauucacccugauugaacaagacggcagcgccuacgugccaggcgaucgagcugcgccgcucggguaccccgacuuuucuggacagcuugagaucgaaguacagacggagacuacaaaaaccggugacaagcugaaaguuacuacauucgaaaugauauugggcccugagaccaaugaggaucaggcaccauaucaagggagaguguucgccuccauuucagcugccgcaagccuagaccuggucgauggaagggugcgggccgucccccguaguaucuacggcuuucaggacgugauuccugaauauaacgauggucuccugguuccacuugcucccccgaucgggccuuuccugccaggcgagguguugcuccgcuuuagaacguacaugaggcagguagacacccaggaugccgcagcggaagcuaucgacugcgcccugccccaagaguucgucucuugguuugcauccaaugccuucacagugcagagcgaggcuuuacugcuacgguaucgaaacacucucaccggacagcugcuuuuugaauguaaguuguacucggagggcuauauugcccugucuuacuccgggccuggaccccucacauucccaucaaauggcuuuuucgaaguugugaguugggucccucgccuguaccagcuugcaagcguggguucccuggcuacugggagaaccuugaagcaauga

SEQ ID NO: 19274 - RNA, 1623 nt, Artificial Sequence
  derived and/or modified sequence opt3 from capsid_protein__Norovirus__ACF41177
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugacgaacucucgcuuucccauaccacuggagaaacuuuucacuggacccagcuccgcguucgugguucagccucagaaugguagauguaccacagauggcguguugcuggggacuacccaacuaucaccagucaacauuugcaguuuuaggggagacgugacacauaucccgggcacccggacguaccgcaugaaucucgccagccagaacuggaauaacuaugaucccacugaggaaauuccugcaccacuggguacacccgacuucguagggaagauccagggaaugcuuacccagacuacaaagggcgacggcucuacccgagggcacaaggcuacgguuuccaccggaucaguggauuuuacaccuaaacuggguagcguccaauucgccacugacaccgauaaugacuuugagacaggccagaacacuagauucaccccagugggggucauccaggauggaaguucuacacauaggaaugaaccccaacaguggguguugccggacuacuccggccggaccguucacaacgugcaccucgcuccugccguagcaccaacuuuucccggugagcagcuguuauucuuucguagcacgaugccuggguguucgggcuaccccaauauggaucuggacugccuccuuccacaggaauggguccaacauuucuaucaggaggccgcuccuucucaguccgauguggcgcuguugcgcuuuguuaaccccgacacaggaagagugcuauucgaguguaagcugcacaaagcaggcuacgucaccguggcccauacugggcagcacgaucucguaauuccaccgaauggauauuuuagguucgacucaugggugaaccaauucuacacccuggcuccuauggguaacggcgccgggcggcgacgcgcaaguuga

SEQ ID NO: 19275 - RNA, 1623 nt, Artificial Sequence
  derived and/or modified sequence opt3 from capsid_protein__Norovirus__ACF41180
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaaccaagcgggacggcagcacgcgcggccacaaggccaccgugucuacaggguccguccauuuuacuccuaaacugggaucagugcaguucagcaccgauacaaguaaugacuuugagaucggucagaacacucgauucaccccagucggcgugguucaagaugggucuacaacccaccagaaugaaccccagcaguggguguugccgaacuacuccggaagagacggccacaauguacaucucgcuccugccgucgcaccaacuuuucccggugagcaacuguuauucuuuaggagcacgaugccuggguguucgggcuaccccaacaugaaucuggauugccuccuuccacaggaaugggugcagcacuucuaucaggagucugccccugcucaauccgacguugcgcuguugcgguuugugaaccccgauacaggacgugcacuauucgaguguaagcugcauaaaucaggcuacgucaccguggcccacacugggcagcacgaccucguaauuccaccgaacggauauuuucgcuucgauaguugggugaaucaguucuacacccuggcuccuauggguaacggcgccgggagaaggcgggcacuuuga

SEQ ID NO: 19276 - RNA, 1623 nt, Artificial Sequence
  derived and/or modified sequence opt3 from capsid_protein__Norovirus__ACF41181
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugacgaacucucgcuuucccauaccacuggagaaacuuuucacuggacccagcuccgcguucgugguucagccucagaaugguagauguaccacagauggcguguugcuggggacuacccaacuaucaccagucaacauuugcacauuuaggggagacgugacccauaucccgggcacgcggacuuaccgcaugaaucucgccagucagaacuggaauaacuaugaucccacagaggaaauuccugcaccacuggguacccccgacuucguagggaagauccagggaaugcuuccucagacuacaaagggcgacggcagcacccgagggcacaaggcuacgguuucuaccggauccguggauuuuacaccaaaacuggguucaguccaauucgccacugacaccgauaaugacuuugagacaggccagaacacuagauucacccccgugggggucauccaggauggaagcaguacacauaggaaugaaccgcaacaguggguguugccugacuacucuggccggaccguuuacaacgugcaccucgcuccagccguagcacccacuuuuccuggugagcagcuguuauucuuucguuccacgaugcccggguguagcggcuauccaaauauggaucuggacugccuccuuccucaggaauggguccaacacuucuaccaggaggccgcucccucgcagucugauguggcgcuguugcgcuuuguuaacccagacacaggaagagugcuauucgaguguaagcugcauaaagcaggcuaugucaccguggcccacacugggcagcaugaucucguaauuccgccuaauggauacuuuagguucgacuccugggugaaccaauucuauacccuggcucccauggguaacggcgccgggcggcgacgcgcacuuuga

SEQ ID NO: 19277 - RNA, 1623 nt, Artificial Sequence
  derived and/or modified sequence opt3 from capsid_protein__Norovirus__ACF41182
augaagauggccagcaacgacgcuucccccucugauggcucaaccgcaaaucuggugccugaggucaacaaugaaguuauggcccucgagccagugguaggggcggcuaucgccgcaccggugacaggacagcaaaacgucauugaccccuggauaagaaauaacuucgugcaggccccugguggcgaauuuacuguuaguccaaggaaugcucccggggagauccuuuggagcgcaccucugggaccagauuugaaccccuacuuaucccaccuggcccggauguauaauggcuacgcugguggguucgaagugcaggucauucuagccggaaacgcguuuacggcaggcaaaaucauuuucgccgcugugccuccaaauuuuccgaccgagggccucucucccucgcagguaacaauguucccucauaucauaguugacgugcgccaacuggagccaguccuuaucccccugccugaugugcgaaacaauuuuuaucacuacaaccagucaaaugacagcacuauuaaguugaucgccaugcucuauaccccacugcgugcaaacaacgcuggggaugacguguucacagucaguugcagaguucugaccaggcccuccccggauuuugacuucauuuuucucgugccucccacuguagaaucucggacaaaaccauucaccgugccuaucuuaacggucgaggaaaugacuaauagccgcuuucccauaccacuggagaaacuuuucaccggacccuccucagccuucgugguucagccucagaacgguagauguacaacugauggcguguugcuggggaccacacaacuaaguccagucaauauuugcaccuuuaggggagacgugacgcauaucccgggcacucggacauaccgcaugaaccucgcgagccagaauuggaacaauuaugaucccaccgaggaaauuccugccccacuggguacucccgacuucguagggaagauccagggaaugcuuacacagaccacgaagggcgacggcucuacccgagggcacaaggcaacaguuuccacuggaucaguggauuuuaccccuaaacuggguagcguccaauucgcuacagacacugauaacgacuuugagaccggccagaauacaagauucaccccagugggggucauccaggauggaaguucuacucauaggaacgaaccccaacaguggguguugccggacuacuccggccggacggcccacaauguucaccucgcuccugccguggcaccaacauuucccggugagcagcuguuauucuuucguagcaccaugccuggguguucgggcuaccccaacauggaucuggacugccuccuuccacaggaauggguacaacauuucuaucaggaggccgcuccuucucaguccgaugucgcgcuguugcgcuuugugaaucccgacacuggaagaguucuauucgaguguaagcugcacaaagcaggcuacgugaccgucgcccauacagggcagcacgaucucgugauuccaccgaacggauauuuuagguucgacucauggguaaaucaauucuacacccuggcuccuauggguaacggcgccgggcggcgacgcgcacuuuga

SEQ ID NO: 19278 - RNA, 1623 nt, Artificial Sequence
  derived and/or modified sequence opt3 from capsid_protein__Norovirus__ACF41183
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcgggccuaccgcaugaaccucgcaagccagaauuggaacaauuaugaucccacugaggaaauuccugcuccacuggguacacccgacuucguagggaagauccagggaaugcuuacccagacuacaaagggcgacggcucuacccgagggcacaaggccacgguuuccaccggaucaguggauuuuacaccuaaacuggguagcguccaauucgcuacugacaccgauaacgacuuugagacaggccagaauacuagauucaccccagugggggucauccaggauggaaguucuacacauaggaacgaaccccaacaguggguguugccggacuacuccggccggaccguucacaaugugcaccucgccccugcaguagccccaacuuuucccggugagcagcuguuauucuuucguagcacgaugccuggguguucgggcuaccccaacauggaucuggacugccuccuuccacaggaauggguccaacauuucuaucaggaggcugcgccuucucaguccgauguggcacuguugcgcuuuguuaaucccgacacaggaagagugcuauucgaguguaagcugcacaaagccggcuacgucaccguggcucauacugggcagcacgaucucguaauuccaccgaacggauauuuuagguucgacucaugggugaaucaauucuacacccuggccccuauggguaacggcgcagggcggcgacgcgcccuuuga

SEQ ID NO: 19279 - RNA, 1623 nt, Artificial Sequence
  derived and/or modified sequence opt3 from capsid_protein__Norovirus__ACF41184
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuagccgucgaagagaugacaaacucucgcuuucccauaccacuggagaaacuuuucaccggacccagcuccgcauuggugguucagccucagaaugguagauguacgacugacggcgugcugcuagggaccacacaacucucaccagucaacauuugcacuuucaggggagaugugacccauaucgcuggcagucggaauuacacaaugaaccuggccagccuuaauuggaacaauuaugacccgaccgaagagauucccgcuccucuggguacgccagauuuuguagggaagauccagggaguuuugacucagacaaccaagggcgacggcucuacucgcgggcacaaggccacaguguacaccggauccgcacccuucacgccuaaacucgguucaguccaguuuggcaccgacacagaaaacgauuucgagacucaucaaaauaccaaguuuacaccagugggggucauccaggacggaagcacuacccaccgaaacgaaccccagcaaugggugcugccgaguuacucuggcagaaauguucacaacgugcauuuagccccugcuguagcgccaacauuccccggugagcagcugcucuuuuucagguccaccaugccuggguguagcggcuaucccaauauggaucuugacugccuguugccacaggaguggguccagcacuuuuaccaagaagcagccccugcucagucggauguggcccuacugcgguucguuaaccccgacacuggacgugugcucuuugaguguaaacugcauaagucuggcuaugucacgguggcacacacagggcagcacgaucuuguaauuccaccgaacggauacuuccgcuuugacuccugggugaaucaguucuauacccuggccccuauggguaacggcacugggagaaggcgggcuuuguga

SEQ ID NO: 19280 - RNA, 1623 nt, Artificial Sequence
  derived and/or modified sequence opt3 from capsid_protein__Norovirus__ACF41185
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcggugccuucgugguucagccucagaauggcagauguacuaccgaugggguguugcugggaacaacucaacuauccccagucaacauuugcaccuuuaggggcgacgugacacauaucgcagguucacgggauuacaccaugaaucucgcuagucugaacuggaauaacuaugacccgacggaggaaauucccgccccucuugggacuccagacuucguaggaaagauccagggcguucugacacagaccacuaagggcgaugggagcacacgcggacacaaggcuaccguguacacggguucugcccccuuuaccccuaaauugggcuccguccaguuccgaacagacacugagaaugauuuugaaacccaucaaaacacaaaguucacuccagugggggucauccaggacggaucaaccacacacagaaaugagccccagcaaugggugcucccgagcuacaguggcaggaacguucacaaugugcaucuggccccugcaguagcuccaaccuuucccggugaacaguuacuguucuuucggucuacuaugccuggguguuccggcuaucccaacauggaucucgacugccuucugccacaggaguggguccagcacuucuaccaagaggcggccccugcacagagcgauguggcuuugcuacguuuuguuaaucccgacacgggacgcgugcuguucgaauguaaacuccauaagucgggcuaugucacaguggcccacaccgggcagcacgaucugguaauuccaccgaacggauacuuuagauucgacucuugggugaaccaguucuauacucuugcaccuauggguaauggcaccgggaggcggcgagcccuguga

SEQ ID NO: 19281 - RNA, 1623 nt, Artificial Sequence
  derived and/or modified sequence opt3 from capsid_protein__Norovirus__ACF41186
augaagauggccagcaacgacgcuaaucccuccggcgggucugcagccaaccuggugccugaggucaauaacgaaguuauggcgcucgagccagugguaggagcugccaucgcagccccgguggcuggucagcaaaaugucauugaucccuggauaagaaacaauuucgugcaggcaccuggcggggaauuuaccguuucaccaaggaacgcccccggagagauccuuuggagugcuccucugggcccagacuugaaucccuacuuaagccaccuggcccggauguauaacgguuacgcagggggauucgaagugcaggucauucuagcaggcaaugccuuuacagcuggcaaaaucauuuucgccgcagugccuccaaacuuuccgacugaggggcucucccccucucagguaacgauguucccucauaucauaguugaugugcgccaacuggagccaguccuuaucccccugccugacgugcgaaauaacuuuuaucacuacaaucagucgaacgauucaaccauuaaguugaucgcuaugcucuauacaccacugcgugccaacaaugcgggagaagacguguucacugucagcugcagaguucugaccaggcccaguccggauuuugacuucauuuuucucgugccucccacaguagagucccggaccaaaccauucacugugccuaucuuaacagucgaagagaugaccaacucucgcuuucccauaccacuggagaaacuuuucacgggucccagcuccgccuucgugguucagccucagaauggcagauguacuaccgaugggguguugcugggaacaacucaacuaucaccagucaacauuugcaccuuuaggggcgacgugacacauaucgcagguagucggaauuacaccaugaaccucgcuagccugaauuggaacaauuaugauccgacggaagagauucccgccccucuugggacuccagacuucguaggaaagauccagggcguucugacacagaccacuaagggcgaugggucuacacgcggacacaaggcuaccguguacacggguuccgcccccuuuaccccuaaauugggcucaguccaguucagcacagacacugaaaacgacuuugagacccaucaagauacaaaguucacuccagugggggucauccaggacggaggcaccacacaccgaaaugaaccccagcaaugggugcucccgaguuacucugguagaaacguucagaaugugcaccuggcgccugccguagcuccaaccuuucccggggagcaguuacuguucuuuagguccacuaugccuggcuguagcggauaucccaacauggaucucgacugccuucugccacaggaguggguccaacauuucuaccaggaagcggccccugcacagucggauguggcuuugcuacgguuuguuaaucccgacacgggccgugugcuguucgaguguaaacuccacaagucuggguaugucacaguggcccauaccggacagcacgaucugguaauuccaccgaacgguuacuuucgcuucgacuccugggugaaccaauucuauacucuugcaccuaugggcaaugggaccggaagaaggcgggcccuguga

SEQ ID NO: 19282 - RNA, 1623 nt, Artificial Sequence
  derived and/or modified sequence opt3 from capsid_protein__Norovirus__ACF41187
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccgcggaguucugacacagaccacuaagggcgacggcucuacacgagggcacaaggcuaccguguacacgggauccgcccccuuuaccccuaaauuggguucaguccaguucagcacagacacugaaaacgauuuugagacccaucagaauacaaaguucacuccagugggcgucauccaagacgggggaaccacacacagaaacgaaccccagcagugggugcucccgaguuacucuggcaggaauguuccuaacgugcaccuggcaccagccguagcucccaccuuuccuggugagcaauuacuguucuuucgguccacuaugcccggguguagcggcuauccaaauauggaucucgacugccuucugccucaggaguggguccagcauuucuaccaggaagcggcacccgcccaaucggauguggcuuugcuacguuuuguuaacccagacacgggacgcgugcuguucgaguguaaacuccacaagucuggcuaugucacaguggcccauaccgggcagcacgaucugguaauuccgccuaacggauacuuuagauucgacuccugggugaaucaguucuauacucuugcacccauggguaacggcaccgggaggcggcgagcccuguga

SEQ ID NO: 19283 - RNA, 1623 nt, Artificial Sequence
  derived and/or modified sequence opt3 from capsid_protein__Norovirus__ACF41188
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccgccuacacgggauccgcacccuuuaccccuaaauuggguucagugcaguucagcacagacacugaaaacgauuuugagacccaucaaaauacaaaguucgccccagucggcgugauccaggacgggggaacuacccaccgaaacgaaccccagcaauggguccucccgaguuacucuggcagaaaugugccuaacguucaccuggcuccagcgguggcacccacauuuccuggugagcaguuacuguucuuuagguccaccaugcccggguguagcggcuauccaaauauggaucucgacugccuucugccucaggaguggguacagcauuucuaccaagaagccgcucccgcccagucggaugucgcauugcuacgguuugugaacccagacacuggacguguucuguucgaguguaaacuccacaagucuggcuaugugacggucgcccauacagggcagcacgaucuggugauuccgccuaacggauacuuucgcuucgacuccuggguaaaucaguucuauacccuugcucccauggguaacggcacugggagaaggcgggcccuguga

SEQ ID NO: 19284 - RNA, 1623 nt, Artificial Sequence; identical to SEQ ID NO: 18261
  derived and/or modified sequence opt3 from capsid_protein__Norovirus__ACF41190

SEQ ID NO: 19285 - RNA, 1623 nt, Artificial Sequence
  derived and/or modified sequence opt3 from capsid_protein__Norovirus__ACF41191
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccgggauuugacuucauuuuucucgugccucccacaguagagucccggaccaaaccauucacugugccuaucuuaacagucgaagagaugaccaacucucgcuuucccauaccacuggagaaacuuuucacgggucccagcuccgccuucgugguucagccucagaauggcagauguacuaccgaugggguguugcugggaacaacucaacuaucaccagucaacauuugcaccuuuaggggcgacgugacacauaucgcagguagucggaauuacaccaugaaccucgcuagccugaauuggaacaauuaugauccgacggaagagauucccgccccucuugggacuccagacuucguaggaaagauccagggcguucugacacagaccacuaagggcgaugggucuacacgcggacacaaggcuaccguguacacggguuccgcccccuuuaccccuaaauugggcucaguccaguucagcacagacacugaaaacgacuuugagacccaucaaaauacaaaguucacuccagugggggucauccaggauggaggcaccacacaccgaaacgaaccccagcaaugggugcucccgaguuacucugguagaaauguuccuaacgugcaccuggcaccagccguagcucccaccuuuccuggggagcaguuacuguucuuuagguccacuaugcccggcuguagcggauauccaaauauggaccucgauugccuucugccucaggaguggguccagcauuucuaccaagaagcggcacccgcccagucggacguggcuuugcuacgguuuguuaacccagauacgggccgugugcuguucgaguguaaacuccacaagucuggguaugucacaguggcccauaccggacagcacgaccugguaauuccgccuaacgguuacuuucgcuucgauuccugggugaaucaguucuauacucuugcacccaugggcaacgggaccggaagaaggcgggcccuguga

SEQ ID NO: 19286 - RNA, 1647 nt, Artificial Sequence
  derived and/or modified sequence opt3 from capsid_protein__Norovirus__ACF60293
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcaggcaaugccuuuacggcuggcaaaauuaucuucgccgcaauacccccuaacuuuccaaucgagaaucuuagugcugcccagauuaccaugugcccgcauguuaucguggacguccggcaacuggaacccgugaacuugccuaugccagauguacgcaauaacuucuuucacuauaaccaggggagcgacuccaagcuccgacugguugcgaugcuguacacaccccuccgugccaauaacucuggagaugacguguucacugucucguguagaguguuaaccaggccuucaccagauuuuagcuucaauuuucuggugcccccgacagucgagaguaaaaccaagccuuucacucuucccauuuugacaaucuccgaaaugucuaacagccgguuuccaguuccuauagacucccugcauaccucacccacggagaauauugugguacagugccagaacggucgcgugacucuagauggcgagcucauggggaccacacaacugcuuccaagucagaucugugcauucagaggaguccugacuaggagcaccucucgggcuuccgaccaggccgauacagcuacgccccgcuuguucaauuauuacuggcacauucagcucgacaaccugaauggcaccccuuaugacccagccgaagauaucccgggucccuuagggacuccugacuuucgaggaaaaguguucggcguugcaucacaaagaaacccagauagcacaaccagggcccaugaggcuaagguggacacuacagcgggccgguuuacccccaagcuggggagucucgaaaucucuacggaguccggagauuucgaccagaaucagccuacccguuuuacaccagucgguauuggcguggaucacgaagcagacuuccaacaguggagccuucccgauuacucggggcaguuuacucacaacaugaaucuggccccggcuguagccccuaacuucccaggagagcaguugcuauuuuuccgcucucaacugcccuccucaggcgguagaaguaaugggauacucgacugcaggguuccucaggagugggugcagcauuuuuaccaggaaagcgcacccgcccaaacccaggucgcucuggugcgguaugucaacccagauacaggccgagugcuuuucgaggccaaacugcacaaguugggauuuaugacuaucgcgaaaaacggcgacuccccuauuaccguucccccaaauggguacuuccgcuucgaaucuugggugaacccguuuuauacacucgcgccuaugggaaccgguaauggcagaaggcggauccaguga

SEQ ID NO: 19287 - RNA, 1647 nt, Artificial Sequence
  derived and/or modified sequence opt3 from capsid_protein__Norovirus__ACF60294
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugguugcgaugcuguacacaccccucagagccaauaacucuggagacgauguguucacugucucguguaggguguuaacccggccuucaccagacuuuagcuucaauuuucuggugcccccgacagucgaaaguaagaccaaaccuuucacucuucccauuuugacaaucuccgagaugucuaacagccgcuuuccaguuccuauagauucccugcauaccucacccacggaaaauauugugguacagugccagaacgguagagugacucuagacggcgagcucauggggaccacacaacugcuuccaagucagaucugugcauucaggggaguccugacucggagcaccucucgcgcuuccgaucaggccgacacagcuacgccccgauuguucaauuauuacuggcacauucagcucgacaaccugaauggcaccccuuaugauccagccgaggacaucccgggucccuuagggacuccugauuuuagaggaaagguguucggcguugcaucacaaaggaacccagacagcacaacccgggcccaugaagcuaaaguggauacuacagcgggccguuuuacccccaagcuggggagucucgagaucucuacggaauccggagacuucgaucagaaucagccuacccgcuuuacaccagucgguauuggcguggaccacgaggcagauuuccaacaguggagccuucccgacuacucggggcaguuuacucacaacaugaaucuggccccggcuguagccccuaacuucccaggagaacaguugcuauuuuucagaucucaacugcccuccucaggcgguaggaguaaugggauacucgauugccugguuccucaggagugggugcagcauuuuuaccaggagagcgcacccgcccaaacccaggucgcucuugugcgguaugucaacccagacacaggccgagugcuguucgaagccaaguugcacaaacucggauuuaugacuaucgcaaagaacggcgacuccccuauuaccguucccccaaauggguacuuccgcuucgagucuugggugaacccguuuuauacacuggcgccuaugggaaccgguaauggcagaaggcggauccaguga

SEQ ID NO: 19288 - RNA, 1647 nt, Artificial Sequence
  derived and/or modified sequence opt3 from capsid_protein__Norovirus__ACF60295
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguaccucugaacuuggaguuaggcccagaaaucaaucccuaccuggcucaccuagccaggauguauaacgguuacgcagggggauucgaggugcaggucgugcucgcgggcaaugccuuuacggcuggcaaaauuaucuucgccgcaauaccuccaaacuuuccgaccgacaaucugagugcugcccagaucacaaugugcccccauguuauuguggauguccggcaacuugagccugugaaccugccaaugcccgacguacgcaauaacuucuuucacuauaaccaggggagcgauucccgauugcgucucguugcgaugcuguacacuccucugagagccaauaacucuggagacgauguguucaccgucucguguagggugcucacacggccaucacccgacuuuagcuucaacuuuuuagugccgccuaccgucgaaaguaagacuaaacccuucacacugccaauccuuaccauuuccgagaugucuaauagccgcuuuccuguucccaucgauuccuugcauacgucaccaacugaaaauauagugguacagugccagaacgguagagugacccuggacggcgagcuaauggggacaacucaacuccugcccagucagauuugugcauucaggggaguccuuacccggagcacaucucgcgcuuccgaucaggccgacaccgcuacgccucgacuguucaauuauuacuggcacauccaguuggacaaccucaauggcacuccauaugauccggccgaggacauucccgguccucuggggacaccagauuuuagaggaaagguguucggcguugcaucacaaaggaaccccgacagcaccacucgggcccaugaagcuaaaguggauacaaccgcgggccguuuuacgccuaaguuagggagucuggagaucucuaccgaauccgacgauuucgaccagaaucagccaacacgcuuuacucccgucggaaucgguguggaucacgaggcagacuuccaacaguggagccucccggauuacucgggccaguuuacccacaacaugaaucuugccccugcuguagccccaaacuuccccggggaacagcuguuguuuuucagaucucaacuaccuuccucaggaggcaggaguaaugguauucuggacugccucguuccccaggagugggugcagcauuuuuaccaggagagcgcaccagcccaaacacaggucgcucuggugcgguaugucaacccugacacugggcgagugcuuuucgaagccaagcugcacaaauugggcuuuaugaccauagcaaagaacggagauucccccaucacaguuccaccgaauggcuacuuccgcuucgagucuugggugaacccuuuuuauacccucgcgcccauggggacuggaaaugguagaaggcggauucaguga

SEQ ID NO: 19289 - RNA, 1647 nt, Artificial Sequence
  derived and/or modified sequence opt3 from capsid_protein__Norovirus__ACF60296
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugguugcgaugcuguacacaccccucagagccaauaacucuggagacgauguguucacugucucguguaggguguuaacccggccuucaccagacuuuagcuucaauuuucuggugcccccgacagucgaaaguaagaccaaaccuuucacucuucccauuuugacaaucuccgagaugucuaacagccgcuuuccaguuccuauagauucccugcauaccucacccacggaaaauauugugguacagugccagaacgguagagugacucuagacggcgagcucauggggaccacacaacugcuuccaagucagaucugugcauucaggggaguccugacucggagcaccucucgcgcuuccgaucaggccgacacagcuacgccccgauuguucaauuauuacuggcacauucagcucgacaaccugaauggcaccccuuaugauccagccgaggacaucccgggucccuuagggacuccugauuuuagaggaaagguguucggcguugcaucacaaaggaacccagacagcacaacccgggcccaugaagcuaaaguggauacuacagcgggccguuuuacccccaagcuggggagucucgagaucucuacggaauccgacgauuucgaccagaaucagccuacccgcuuuacaccagucggaauugguguggaucacgaggcagacuuccaacaguggagccuucccgauuacucgggccaguuuacucacaacaugaaucuggccccggcuguagccccuaacuucccaggggaacaguugcuauuuuucagaucucaacugcccuccucaggaggcaggaguaaugguauacucgacugccugguuccucaggagugggugcagcauuuuuaccaggagagcgcacccgcccaaacccaggucgcucuugugcgguaugucaacccagacacagggcgagugcuguucgaagccaaguugcacaaacucggcuuuaugacuaucgcaaagaacggagauuccccuauuaccguucccccaaauggcuacuuccgcuucgagucuugggugaacccguuuuauacacuggcgccuauggggaccggaaaugguagaaggcggauccaguga

SEQ ID NO: 19290 - RNA, 1647 nt, Artificial Sequence
  derived and/or modified sequence opt3 from capsid_protein__Norovirus__ACF60297
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugguugcgaugcuguacacaccccucagagccaauaacucuggagacgauguguucacugucucguguaggguguuaacccggccuucaccagacuuuagcuucaauuuucuggugcccccgacagucgaaaguaagaccaaaccuuucacucuucccauuuugacaaucuccgagaugucuaacagccgcuuuccaguuccuauagauucccuguauaccucacccacggaaaauauugugguacagugccagaacgguagagugacucuagacggcgagcucgucgggaccacacaacugcuuccaagucagaucugugcauucaggggagugcugacucggagcaccucucgcgcuuccgaucaggccgacacagcuacgccccgauuguucaauuacuauuggcauauucagcucgacaaccugaauggcaccccuuacgauccagccgaggacaucccgggucccuuagggacuccugauuuuagaggaaagguuuucggcguggcaucacaaaggaacccagacagcacaacccgggcccacgaagcuaaagucgauacuacagcgggccguuuuacccccaagcuggggagucucgagaucucuacggaauccggagacuucgaucagaaucagccuacccgcuuuacaccaguggguauuggcguagaccaugaggcagauuuccaacaguggagccuucccgacuacucggggcaguuuacucacaacaugaaucuggccccggcuguugccccuaacuucccaggagaacaguugcuauuuuucagaucucaacugcccuccucaggcgguaggaguaaugggauacucgauugccuggugccucaggaguggguccagcacuuuuaucaggagagcgcacccgcccaaacccagguggcucuuguccgguacgugaacccagacacaggccgaguucuguucgaagccaaguugcauaaacucggauuuaugacuaucgcaaagaacggcgacuccccuauuaccgugcccccaaauggguauuuccgcuucgagucuuggguaaacccguuuuacacacuggcgccuaugggaaccgguaauggcagaaggcggauccaguga

SEQ ID NO: 19291 - RNA, 1626 nt, Artificial Sequence
  derived and/or modified sequence opt3 from capsid_protein__Norovirus__ACF72688
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuuccaaggggucuuugaccacagcucagauuacuuguuucccgcauguaaugugcgacguucggacccucgaacccauccaacugccucugcucgaugugcgccgagucuuauggcacgccacacaggaccaggaggagucgaugcgucugguguguaugcuuuauaccccauugagaacuaauucacccggagaugagagcuuuguggucagugguaggcugcuauccaaaccugcgccagacuucaacuuuguuuaccucacacccccgauagaacggaccaucuaucgcaugguggaucugccucuucugcagcccagauugugcacgcaugccagguggccagcaccuguauacggccuccugguggaccccucuuuaccaagcaauccccaauggcagaacgggcggguccacguggauggaacucugcucggcaccacaccuguuuccgguucaugggugaguuguuucgcugccgaagcugccuaugaguuucagagcgggauuggagaggucgugacuuucaccaugaucgaacaagacggcucugcauacguaccaggcgaucgcgccgcuccgcuuggguaccccgacuuuuccggacagcuggagauugaaguucagacagagaccacgaagacuggugacaaauugaaggugacaaccuucgaaaugauccuaggcccuacuacaaaugucgaucaggcgccauaucaagggcgagcauacgccucacugaccgcuauggccagccucgaccugguggauggaagagucagggcagugccccggaguauauauucuuuccaggacgagcuuccugaguacaacgauggccuguugguuccacucgccccuccgcugggucccuuuuuaccaggggaagugcugcuacguuuccgcacguauaugagacagcucgacaccgcugaugccgcagcgcagcccauugacugcgcucugccucaagaguuuaucuccugguucgccagcaauaacuuuacaguacagucggaugcacuuuuggucagguaccggaauacucugaccggccagcuccuguucgaagccaaacuuuauucugagggauacauugcuguguccuacucaggcagugggccccugacauuuccaacugacggauucuuugaaguugugagcugggucccucgauuguuccagcucgccuccguggguucucuggcaaccggccgcacauuaaagcaauga

SEQ ID NO: 19292 - RNA, 1623 nt, Artificial Sequence
  derived and/or modified sequence opt3 from capsid_protein__Norovirus__ACH42093
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccaaauucacaccagucggcgugguucaagaugggucuaccacucaccagaaugaaccccagcaguggguguugccggacuacuccggaagagauagccacaacguacaucucgcuccugccgucgcaccaacguuucccggcgagcaacuguuauucuuuaggucgacaaugccugguuguucuggguaccccaauaugaaccuggacugccuccuuccacaggaaugggugcagcacuucuaucaggaguccgccccugcucaaucagauguugcgcuguugcgguuugugaaucccgacaccggccguguccuauucgaguguaagcugcauaaaaguggauacgugacuguagcacacaccggccagcacgaucucgugaucccaccgaacggguauuuucgcuucgacagcuggguuaaccaguucuacacacuggccccuaugggaaauggugcuggcagaaggcgggcccuuuga

SEQ ID NO: 19293 - RNA, 1623 nt, Artificial Sequence; identical to SEQ ID NO: 18127
  derived and/or modified sequence opt3 from capsid_protein__Norovirus__ACH42094

SEQ ID NO: 19294 - RNA, 1623 nt, Artificial Sequence; identical to SEQ ID NO: 18127
  derived and/or modified sequence opt3 from capsid_protein__Norovirus__ACH42096

SEQ ID NO: 19295 - RNA, 1623 nt, Artificial Sequence; identical to SEQ ID NO: 18127
  derived and/or modified sequence opt3 from capsid_protein__Norovirus__ACH42097

SEQ ID NO: 19296 - RNA, 1623 nt, Artificial Sequence; identical to SEQ ID NO: 18127
  derived and/or modified sequence opt3 from capsid_protein__Norovirus__ACH42098

SEQ ID NO: 19297 - RNA, 1623 nt, Artificial Sequence
  derived and/or modified sequence opt3 from capsid_protein__Norovirus__ACJ66263
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggaacaauuacgauccgacugaggaaauucccgccccucuggguacaccagacuuuguagggaagauccagggaaugcuuacccagacuacacgaagcgacggcucuaccagaggccacaaagcuacgguucugaccggguccgccgauuucgcacccaaguugggaagggugcaauuugccacagacacugauaacgacuucgagucaggucagaauaccaaguuuacaccugucggcgugauccaggaugggagcacuacccaucggaacgaaccacaacaguggguccuccccaauuacaguggacguacaggccacaacgugcaccuggcuccggcgguugcaccuaccuauccaggugagcaguuacuguucuuucgcucuacuaugcccggguguuccggcuacccuaauauggaccucgauugccuucugccccaggaaugggugcaacauuucuaucaggaggccgcuccagcccagagcgacguagcauugcuaagauuugucaacccugauacgggaagggugcuguucgaguguaaacuccacaagucgggcuacguuacaguggcccauaccgggcagcacgaccuggucauucccccaaacggauauuuucgguucgauucuugggugaaucaauuuuacacucuugcuccgauggguaacggcgccgggcgacgcagagcacuguga

SEQ ID NO: 19298 - RNA, 1623 nt, Artificial Sequence
  derived and/or modified sequence opt3 from capsid_protein__Norovirus__ACJ66265
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccaugucaccucauaucauaguugacgugcgccaacuggagccaguccuuaucccccugccugaugugcgaaacaauuucuaucacuacaaccagagcaaugacccaacaauuaaguugaucgcaaugcucuauacuccccugcgugcuaacaacgccggggaugacguguuuaccgucaguugcagaguucugacaaggccguccccugauuucgacuuuauuuuccucgugcccccaaccguagaaucucggacuaaaccuuuuagcgugcccaucuuaacagucgaggaaaugaccaauucccgcuucccaauaccccuggagagacuuuuuacgggaccuucaagugcguucgugguucagccacagaacgguagguguacuaccgauggcguguugcuggggacaacucaacuaagcccggucaauauuugcaccuuccggggagacgugacacauaucgccggcacccaggaguacacgaugaaccucgcaucucagaauuggaacaauuaugaucccacugaagagauuccugcuccacuggguacacccgacuuuguagggaagauccagggaguucuuacccaaacuacacgccgagacggcuccaccagaggccacaaagccacggugucaaccgggagcguccauuucacaccuaagcugggaaggauccaguuuaguacugauaccucuaacgacuucgaaacaggucagaauacucgguuuaccccagugggcgucgugcaagaugggggaacaacccaccagaacgagccccagcaguggguuuugccgaauuacuccggccgugacggucacaacgugcaucucgcuccugccguagcacccagcuucccaggggaacaacuguuauuuuuccgcucgacuaugccuggcuguucuggauaccccaauaugaaccuggauugccuccuuccacaggaguggguccagcacuuuuaucaggaggccgcuccugcgcaauccgacguggcacuguugagauucguuaaucccgauacgggcagggugcuauuugaauguaagcugcauaaaucaggguacgucacaguggcccacaccggacagcacgaccucguaauuccaccgaacgguuauuuccgguuugauaguugggugaaccaguucuacacucuggcuccuaugggcaaugggaccggacgacgcagagcccuuuga

SEQ ID NO: 19299 - RNA, 1623 nt, Artificial Sequence
  derived and/or modified sequence opt3 from capsid_protein__Norovirus__ACJ66267
augaagauggccagcaacgacgcuaaucccuccgauggcucuaccgcaaaccuggugccugaggucaauucagaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucacagugcccaucuuaaccgucgaggaaaugacuaauucucgcuuuccaauaccccuggagagacuuuacacgggaccuagcuccgcguucgugguucagccacagaacgguagguguaccacagauggcguguugcuggggacuacccaacuaucagccgucaauauuugcacauuccggggagacgugacccauaucgcaggcagucgcaacuauacgaugaaucucgcuagccagaacuggaauaacuacgauccgacugaggaaauucccgccccucuggguacaccagacuuuguagggaagauccagggaaugcuuacccagacuacacgaucugacggcuccaccagaggccacaaagcuacgguucugaccgggucagccgauuucgcacccaaguugggaagggugcaauuugccacagacacugauaaugacuucgagagcggucagaacaccaaguuuacaccugucggcgugauccaggaugggaguacuacccaucggaaugaaccacaacaguggguccuccccucuuacuccggacguacaggccacaacgugcaccuggcuccggcgguugcaccuaccuauccaggugagcaguuacuguucuuucgcagcacuaugcccggguguucgggcuacccuaauauggaccucgauugccuucugccccaggaaugggugcaacauuucuaucaggaggccgcuccagcccagucugacguagcauugcuaagauuugucaacccugauacgggaagggugcuguucgaguguaaacuccacaaguccggcuacguuacaguggcccauaccgggcagcacgaccuggucauucccccaaauggauauuuucgguucgauucaugggugaaccaauuuuacacucuugcuccgauggguaacggcgccgggcgacgcagagcacuguga

SEQ ID NO: 19300 - RNA, 1623 nt, Artificial Sequence
  derived and/or modified sequence opt3 from capsid_protein__Norovirus__ACJ66269
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagagacuuuucacgggaccuuccucagcguucgugguucagccacagaacgguagguguacuaccgauggcguguugcuggggacaacucaacuaaguccggccaauauuugcaccuuucggggagacgucacacauaucgcaggcacccaggaguacacgaugaaccucgcuagccagaauuggaacaauuaugaucccacugaagagauuccugccccacuggguacacccgacuucguggggaagauccagggaguacuuacccaaacuacacgccgagacggcucuaccagaggccacaaagcuacgguuuccaccgggucagugcauuuuacaccuaagcugggaaggauccaguucagcacugauaccaguaacgacuuugaaacaggucagaauacucgguucaccccagucggcgugguccaagaugggggaacaacccaccagaacgagccccagcaguggguguugccgaauuacucuggccgugacggucacaacguucaucucgccccugcaguggccccauccuuucccggggaacaacuguuauucuuucgcagcacuaugccuggcuguucgggauaccccaauaugaaccuggauugccuccuuccacaggaguggguacagcacuucuaucaggaggcugcgccugcacaaucugacgucgcccuguugagauuugugaaucccgauacgggcaggguucuauucgaauguaagcugcauaaauccggguacgugacagucgcucacaccggacagcacgaccucgugauuccaccgaacgguuauuuucgguucgauucauggguaaaccaguucuacacucuggccccuaugggcaaugggaccggacgacgcagagcacuuuga

SEQ ID NO: 19301 - RNA, 1623 nt, Artificial Sequence
  derived and/or modified sequence opt3 from capsid_protein__Norovirus__ACJ66271
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagagacuuuucacgggaccuuccucagcguucgugguucagccacagaacgguagguguacuaccgauggcguguugcuggggacaacucaacuaaguagcgucaauauuugcaccuuucggggagacgugacacauaucgccggcacccaggaguacacgaugaaccucgcaucucagaauuggaacaauuaugauccgacugaagagauucccgcuccucuggguacaccagacuucguagggaagauccagggaguucuuacccaaacuacacgccgagacggcuccaccagaggccacaaagccacggugucaaccgggagcguccauuuuacacccaagcugggaaggauccaguucaguacugauaccucuaacgacuuugaaacaggucagaauacucgguucaccccugugggcgucgugcaagauggguccacaacccaccagaacgagccacagcaguggguuuugcccaauuacagcggacgugacggccacaacgugcaucucgcuccggccguagcaccuucguuuccaggugaacaacuguuauucuuucgcucuacuaugcccggguguuccggcuacccuaauaugaaccuggauugccuccuuccccaggaguggguccagcacuucuaucaggaggccgcuccagcgcaaucagacguggcacuguugagauuuguuaauccugauacgggaagggugcuauucgaauguaagcugcauaaaaguggcuacgucacaguggcccacaccgggcagcacgaccucguaauucccccaaacggauauuuucgguucgauagcugggugaaccaguucuacacucuggcuccgauggguaauggcaccgggcgacgcagagcccuuuga

SEQ ID NO: 19302 - RNA, 1623 nt, Artificial Sequence
  derived and/or modified sequence opt3 from capsid_protein__Norovirus__ACJ66273
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgccaacuggagccaguccuuaucccccugccugaugugcgaaacaauuuuuaucacuacaaccagagcaaugacccaacaauuaaguugaucgcaaugcucuauacuccccugcgugcuaacaacgccggcgaugacguguucaccgucaguugcagaguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccgggacccaggaguacacgaugaaccucgcaucucagaauuggaacaauuaugaucccacugaagagauuccugcuccacugggcacacccgacuucguagguaagauccaggggguucuuacccaaacuacacggcgcgacggauccacccgaggccacaaggccacggugucaaccggcagcguccauuuuacaccuaagcuggggagaauccaguucaguacugauaccucuaacgacuuugaaacaggacagaauacuagguucaccccagugggugucgugcaagauggcuccacaacccaccagaacgagccccagcaguggguuuugccgagcuacucggggcgggacucucacaaugugcaucucgcuccugccguagcaccauccuuucccggagaacaacuguuauucuuucguucaacuaugccuggcuguagugguuaccccaacaugaaucuggauugccuccuuccacaggaguggguccagcacuucuaucaggaggccgcuccugcgcaaagcgacguggcacuguugcgcuuuguuaaccccgauacggggagagugcuauucgaauguaaacugcauaaguccggcuacgucacaguggcccacaccggacagcacgaccucguaauuccaccgaauggcuauuuuagguucgauucuugggugaaccaguucuacacucuggcuccuauggggaacggagccggucggcgacgcgcacuuuga

SEQ ID NO: 19303 - RNA, 1623 nt, Artificial Sequence
  derived and/or modified sequence opt3 from capsid_protein__Norovirus__ACJ66275
augaagauggccagcuccgacgcuucucccucagauggcagugcagccaaccuggugccugaggucaauaacgaaguuauggcgcucgagccagugguaggggcugccaucgcagccccgguggcuggacagcaaaauauuauagaccccuggaucagaaacaauuucguccaggcaccugguggcgaauuuaccgugagcccaaggaacgcccccggggagauucuuugguccgcuccucugggaccagauuugaaucccuacuuaucucaccugucgcggauguauaacggcuacgccgguggguucgaaguucaggugauccuagcgggaaaugcauuuacagccggcaaagucauuuucgcugccgugccuccaaacuuuccgacugagggccucucacccagccagguaacgauguucccucauaucauaguugacgugcgccaacuggagccaguccuuaucccccugccugaugugcgaaauaacuuuuaucacuacaaucagaccaacgacccaacaauuaaguugaucgcaaugcucuauacuccccugcgugcuaauaacgccggggaugacguguucaccgucaguugcagaguucugacaaggccguccccugauuuugacuucauuuuucucgugcccccaaccguagaaucucggacuaaaccuuucacagugcccaucuuaaccgucgaggaaaugacgaacagccgcuuuccaauaccccuggagagacuuuacacuggaccuuccucagcguucgugguucagccacagaaugguagguguaccacagauggcguguugcuggggacuacccaacuaagugccgucaacauuugcacauuccggggagacgugacccauaucgcaggcagccgcaauuauacgaugaaccucgcuucucagaauuggaacaauuacgauccgacugaggaaauucccgccccucuggguacaccagacuuuguagggaagauccagggaaugcuuacccagacuacacgaggcgacggcuccaccagagggcacaaagcuacgguuuacaccggaucagccgauuucgcacccaagcuggguagggugcaauuugccacagacacugauaacgacuucgagagcaaucagaacaccaaguuuacaccugucggcgugauccaggaugggaauacuacccaucggaacgaaccacaacagugggucuugcccggauauaguggccgugacggucacaaugugcaccucgcuccggcgguugcaccuacauacccaggggagcagcuguuauucuuucgcucuaccaugcccggcuguuccggauauccuaacauggaucuggacugccuccuuccccaggaaugggugcaacauuucuaccaggaggccgcuccagcccagagcgagguagcacuguugagauuugucaauccugauacuggcagggugcuauucgaauguaaacugcacaagucgggguauguuacgguggcccauacaggacagcacgaccucgucauucccccaaacgguuacuuucgguucgauucuugggugaaccaauuuuauacccuggcuccgaugggcaauggggccggacgacgcagagcacuuuga

SEQ ID NO: 19304 - RNA, 1623 nt, Artificial Sequence
  derived and/or modified sequence opt3 from capsid_protein__Norovirus__ACJ66279
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccguccauuuuacuccuaagcugggaucagugcaguucagcaccgauacaaguaaugacuuugagacuggucagaacaccagauucacaccagucggcgugguucaagaugggucuaccacucaccagaaugaaccccagcaguggguguugccggacuacuccggaagggauagccacaacguacaucucgcuccugccgucgcaccaaauuuucccggcgagcaacuguuauucuuucggucgacgaugccugguuguucuggguaccccaacaugaaucuggacugccuccuuccacaggaaugggugcagcacuucuaucaggaguccgccccugcucaaucagauguugcgcuguugcguuuugugaaccccgacacaggccgcguccuauucgaguguaaacugcauaagaguggauacgugaccguagcacacacuggccagcacgaucucgugaucccaccgaacggguauuuuagauucgacagcuggguuaaucaguucuacacccuggccccuaugggaaacggugcuggcaggcggcgagcccuuuga

SEQ ID NO: 19305 - RNA, 1623 nt, Artificial Sequence
  derived and/or modified sequence opt3 from capsid_protein__Norovirus__ACJ66281
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaaaagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaggaaauucccgccccucuugggacuccagauuucguaggaaagauccagggcguucugacacagaccacuaagggcgacgggucuacacgcggacacaaagcuaccguguacacggguuccgcccccuuuaccccuaaguugggcucaguccaguucagcacagacacugagaaugauuuugaaacccaucaaaacacaaaauucacuccagugggggucauccaggacggaaguaccacacaccgaaaugagccccagcaaugggugcucccgucuuacuccggcagaaacguucacaaugugcaucuggccccugcaguagcuccaaccuuucccggugaacaguuacuguucuuuaggagcacuaugccuggguguucgggcuaucccaacauggaucucgacugccuucugccacaggaguggguccagcacuucuaccaagaggcggccccugcacagucugauguggcuuugcuacgguuuguuaaucccgacacgggacgugugcuguucgaauguaagcuccauaaauccggcuaugucacaguggcccacaccgggcagcacgaucugguaauuccaccgaacggauacuuucgcuucgacucaugggugaaccaguucuauacucuugcaccuauggguaauggcaccgggagaaggcgggcccuguga

SEQ ID NO: 19306 - RNA, 1623 nt, Artificial Sequence
  derived and/or modified sequence opt3 from capsid_protein__Norovirus__ACJ66283
augaagauggccagcaacgacgcuaaucccuccgauggcucugcagccaaccuggugcucgaggucaauaacgaaguuauggcgcuugagccugugguaggggcugccaucgcagccccaguggcuggacagcaaaaugucauugacccguggauaagaaacaauuucgugcaggcacccgguggcgaauuuaccguuucaccuaggaacgccccaggggagauccuguggagugcucccuugggaccugauuuaaauccauaccugagccaccuagcccggauguauaacggcuacgcggguggguucgaagugcaggucauucucgcaggaaaugccuuuacagcuggcaaaaucauuuucgccgcagugcccccuaacuuuccaacugagggccuguccccgucucagguaacgauguucccccauaucauaguugacgugcgccaacuugagccuguccugaucccauugcccgaugugcgaaauaacuuuuaucacuacaaucagucgaacgacucaaccauuaagcucaucgcuaugcuguauacaccucugcgugccaacaaugcgggggaagauguguucacugucagcugcagaguucucaccaggccaagucccgacuuugauuucauuuuucuggugccgccuacaguagagucccggaccaaacccuucacugugccaauccugacagucgaagagaugaccaacucucgcuuuccuauaccccuugagaaguuguucacgggaccaagcggugccuucgugguucagccccagaauggcagauguacuaccgacggggugcugcuaggaacaacucaacucuccccugucaacauuugcaccuuuaggggcgaugugacacauaucgcagguucacggaauuacaccaugaaccuggcuagucuuaauuggaacaauuaugacccaacggaagagauuccggcuccccuggggacuccugauuucguaggaaaaauccagggcguuuugacacagaccacuaagggcgacgggagcacacgcggacacaaggccaccguguacacggguucugccccauuuacccccaaacucggcuccguccaguucucaacagacacugaaaacgauuuugagacccaucaaaauacaaaguucacuccugugggggucauccaggacggaagcaccacacaccgaaacgaaccacagcaaugggugcugcccaguuacucuggcagaaauguucacaacgugcauuuagcaccggccguagcuccuaccuuuccaggugagcaguuacucuucuuuagguccacuaugcccggguguagcggcuauccuaauauggaucuugacugccuguugccccaggaguggguccagcacuucuaccaagaagcggcaccagcccagucggauguggcucuacugcgguuuguuaacccugacacgggacguguccucuucgaguguaaacugcauaagucuggcuaugugacaguggcccacaccgggcagcacgaucuuguaauucccccaaacggauacuuucgcuucgacuccugggugaaucaguucuauacucuggcaccgauggguaacggcaccgggagaaggcgggccuuguga

SEQ ID NO: 19307 - RNA, 1623 nt, Artificial Sequence
  derived and/or modified sequence opt3 from capsid_protein__Norovirus__ACJ66285
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccagaauaaggaauaacuucgugcaggcuccugguggcgaauuuacaguuaguccacggaaugcacccggggagauccuuuggagcgccccucugggaccagauuugaaccccuacuuaucccaccuggcucgcauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucauaguugacgugcgacaacuggagccaguccuuaucccccugccugaugugcguaacaauuuuuaucacuacaaccagagcaaugacccaacaauuaaguugaucgcaaugcucuauacuccccugagagcuaacaacgccggcgaugacguguucaccgucaguugcuggguucugacaaggccguccccugauuuugacuucauuuuucucgugcccccaaccguagaaucucggacuaaaccuuucagcgugcccaucuuaacagucgaggaaaugaccaauucccgcuuuccaauaccccuggagaaacuuuucacggggccuucaagugcguucgugguucagccacagaacggaagauguacuaccgaugguguguugcugggcacaacucaacuaagcccggucaauauuugcaccuuuaggggagacgugacacauaucgccgggacccaggaguacacgaugaaccucgcaucucagaauuggaacaauuaugaucccacugaagagauuccugcuccacugggcacacccgacuucguagguaagauccaggggguucuuacccaaacuacacgguccgacggaucaacccgcggccacaaggccacggugagcaccggcaguguccauuuuacaccuaagcuggggcgaauccaguucucuacugauaccuccaacgacuuugaaacaggacagaauacuagauucaccccagugggugucgugcaagauggcagcacaacccaccagaacgagccccagcaguggguuuugccgaauuacucggggagggacucucacaacgugcaucucgcuccugccguagcaccauccuuucccggagaacaacuguuauucuuucggucaacuaugccuggcuguagugguuaccccaauaugaaccuggauugccuccuuccacaggaguggguccagcacuucuaucaggaggccgcuccugcgcaaagcgacguggcacuguugcguuuuguuaaucccgauacggggcgcgugcuauucgaauguaaacugcauaaguccggcuacgucacaguggcccacaccggacagcacgaccucguaauuccaccgaacggcuauuuuagauucgauucuugggugaaccaguucuacacucuggcuccuauggggaauggaaccgguaggcggcgagcccuuuga

SEQ ID NO: 19308 - RNA, 1623 nt, Artificial Sequence; identical to SEQ ID NO: 18112
  derived and/or modified sequence opt3 from capsid_protein__Norovirus__ACJ66286

SEQ ID NO: 19309 - RNA, 1626 nt, Artificial Sequence
  derived and/or modified sequence opt3 from capsid_protein__Norovirus__ACJ72216
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcggccgacuucaacuuuguuuaccucacacccccgauagagcggaccaucuaucgcaugguggaucugccuguacuucagcccagacugugcacgcaugcaagguggccagcuccuauuuacggcuugcucguggaccccucccugccaucuaauccccaauggcagaacgggcggguccacguggauggaacuuuacugggcaccacaccuaucagcgguuccuggguuucauguuucgccgcugaagccgcauaugaguuucagagugggacuggagagguggucaccuucagcaugauugaacaagacggcucugccuacgugccaggcgaucgcgcugcgccgcucggguaccccgacuauuccggacagcuugagaucgaaguacagacagagaccacgaaggccggugacaaacugaagguuacuacauuugaaaugauauugggcccuaccacuaauguggaucaggcaccauaccaagggaaggcuuaugccucacuaagcacaaccgcaagucuggaccucgucgauggacgagugagagccguccccaggucuguguacuccuuccaggacguucugccugaguauaacgauggccuucuggugccauuggcucccccgcucgguccuuaccugccaggggagguauuacugcgguuccguacguauaugcgccagcuagacaccgccgaugcagcggcucagcccauugacugcgcccucccucaagaauuuaucagcugguucgcaucgucuaauuuuacaguccaguccgaggcccugcuugugagauacaggaacacuuugaccggccagcuccuguucgaagcuaaacuguacucagagggauauauugccguuaguuacagcggcuccgggccccuuacauuuccaacugauggauucuuugaaguggucucuugggugccucggcuguuccaguuggcaagcguagguucacucgcuaccggccgaacacugaagcaauga

SEQ ID NO: 19310 - RNA, 1620 nt, Artificial Sequence
  derived and/or modified sequence opt3 from capsid_protein__Norovirus__ACL27297
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggcggauguguucaccgucagcagaaggguucugacacggcccaguccggacuuugauuucaucuuuuccgugccucccaccguagaaucucgcacuaaaccauucacagugccuauucucaccgucgaggaaaugagcaacuccagauuucccauaccauuagagaagcuguacacgggacccucaagugccuucgugguucagccucagaaugguaggugcacuaccgacggcgugcuuuuggggacaacucaacugagcgcagucaacauuuguaccuuccggggagaugugacacauaucgcuggcucucacgacuauaccaugaaucuagccucccagaacuggaauaacuacgauccaacggaggaaauuccggcuccccucgguacuccugacuuuguagggaaaauccagggaaugcugacacagaccacucgcgaggacggcucaacacgagcccauaaggcaaccguuagcacgggcagugugcacuucaccccaaaacuugggucuguccaauacacaacugauaccaauaacgacuuucagacaggacagaauacuaaguucacccccgugggugucauccaagauggcaacaaucaccagaacgaaccucagcagugggugcugccaaauuauuccgggagaacaggacauaacguucacuuggcccccgcuguggcgccgaccuuuccuggcgagcaacuccuguucuuuaggagcacuaugccagguugcucgggguaccccaacaugaauuuagacugucugcucccucaggaauggguacagcauuucuaucaggaggcagcccccgcucaaucugaugucgcccuucugcgguuugugaacccagacacgggccguguuuuguucgagugcaagcuacacaaauccggauacgugacagucgcacacaccggcccucaugaucuggugauucccccaaauggguauuuucgcuucgacucauggguaaaccaguuuuacacucucgccccgaugggaaauggugcuggcagaaggcgggcccuguga

SEQ ID NO: 19311 - RNA, 1623 nt, Artificial Sequence
  derived and/or modified sequence opt3 from capsid_protein__Norovirus__ACL27298
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaagauguguucaccgucagcugcagaguucugacaaggccgaguccugacuuugauuucauuuuucucgugcccccaaccguagagucccggacuaaaccuuucacagugcccaucuuaaccgucgaagagaugacuaauucucgcuuuccaauaccccuggagaaacuuuucacgggaccuagcggugcguucgugguucagccacagaacggcagauguaccacagacgggguguugcugggaacuacccaacuauccccggucaauauuugcacauuuaggggcgaugugacccauaucgccgguacgcacgacuacacuaugaaccucgcaucacagaauuggaacaauuaugaucccacagaagagauuccugcuccacuggggacccccgacuucguaggaaagauccagggcguucuuacucagacaacccggggcgacgggaguacgcgcggacauaaggccaccgugagcacagguucuguccacuuuacuccuaagcugggcuccgugcaauucaccacagauacuaacaaugacuuugaaaccgggcagaacacaaaauucaccccagucggagugguucaggauggcaauucaacucaccaaaacgagccccagcaguggguguugccgaauuacagcggucgaacggggcauaacguacaccucgcuccugccgucgcaccaacauuucccggcgaacagcuguuauucuuuagaaguaccaugccuggauguucuggcuaccccaauaugaaccuggacugccuccuuccacaagagugggugcagcauuucuaucaggaggccgcuccugcgcaguccgauguugcacuguugagguuugugaaccccgacacugggcggguccuauucgaauguaagcugcacaaaagcggauacgugaccguagcccacacaggucaacaugaucucgugaucccaccgaauggcuauuuucguuucgacucguggguuaaccaguucuacacccuggcuccuauggggaauggagccggccgcagaagggcacuuuga

SEQ ID NO: 19312 - RNA, 1623 nt, Artificial Sequence
  derived and/or modified sequence opt3 from capsid_protein__Norovirus__ACL27299
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaugaucguugacgugcgccaacuggagccaguccuuauaccccugccugaugugcgaaauaacuuuuaucacuacaaucagucgaacgacccaacaaucaaguugauugcaaugcucuauacuccccugcgugcuaacaaugccggggaugacguguucaccgucucaugcagaguucugacaaggccgagcccugauuuugacuucaucuuucucgugcccccaaccguagaaagucggacuaaaccuuucacagugcccauuuuaaccgucgaggaaaugacgaacucccgcuuuccaaucccccuggagagacuuuacacuggaccuucuagcgcguucgugguucagccacagaaugguagguguaccacagauggcguguugcuggggacuacccaacuauccgccgucaacauaugcacauuccggggagacgugacccauauugcaggcucacgcaauuauacgaugaaccucgcuagucagaauuggagcaacuacgauccgacugaggaaauccccgccccucuggguacaccagacuuuguagggaagauucagggaaugcuuacccagacuacacgaagagacggcucuaccaggggccacaaagcuacgguucugaccggguccgccgauuucgcacccaaguugggacgggugcaauuugccacagacacugauaaugacuucgagucaggugaaaacaccaaguuuacaccugucggcgugauccaggaugggagcacuacccaucguaaugagccacagcaauggguccuccccaacuacaguggacgcacaggccacaaugugcaccuggcuccggcgguugcaccuaccuauccaggugaacaguuacuguucuuuagaucuacuaugcccggguguuccggcuacccuaacauggaccucgauugccuucugccccaggagugggugaggcauuucuaucaggaggccgcuccagcccaaagcgacguagcauugcuacgguuugucaauccugauacgggacgagugcuguucgaauguaaacuccacaagucgggcuacguuacaguggcccauaccgggcagcacgaccuggucauucccccaaacggauauuuucgcuucgauucuugggugaaccaguuuuacacucuugcuccgauggguaauggcgccgggagaaggcgggcacuguga

SEQ ID NO: 19313 - RNA, 1623 nt, Artificial Sequence
  derived and/or modified sequence opt3 from capsid_protein__Norovirus__ACL27300
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucacagugcccaucuuaaccgucgaggaaaugacgaacucccgcuuuccaauaccccuggagagacuuuacacuggaccuucuagcgcguucgugguucagccacagaaugguagguguaccacagauggcguguugcuggggacuacccaacuauccgccgucaacauuugcacauuccggggagacgugacccauaucgcaggcucacgcaauuauacgaugaaccucgcuagucagaauuggagcaacuacgauccgacugaggaaauucccgccccucuggguacaccagacuuuguagggaagauccagggaaugcuuacccagacuacacgaagagacggcucuaccaggggccacaaagcuacgguucugaccggguccgccgauuucgcacccaaguugggacgggugcaauuugccacagacacugauaaugacuucgagucaggugaaaacaccaaguuuacaccugucggcgugauccaggaugggagcacuacccaucguaaugagccacagcaauggguccuccccaacuacaguggacgcacaggccacaaugugcaccuggcuccggcgguugcaccuaccuauccaggugaacaguuacuguucuuuagaucuacuaugcccggguguuccggcuacccuaacauggaccucgauugccuucugccccaggagugggugaggcauuucuaucaggaggccgcuccagcccaaagcgacguagcauugcuacgguuugucaauccugauacgggacgagugcuguucgaauguaaacuccacaagucgggcuacguuacaguggcccauaccgggcagcacgaccuggucauucccccaaacggauauuuucgcuucgauucuugggugaaccaguuuuacacucuugcuccgauggguaauggcgccgggagaaggcgggcacuguga

SEQ ID NO: 19314 - RNA, 1623 nt, Artificial Sequence
  derived and/or modified sequence opt3 from capsid_protein__Norovirus__ACL31312
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcacccaggaguacacgaugaaccucgcaagccagaauuggaacaauuaugaucccacugaagagauuccugcuccacuggguacacccgacuucguagggaagauccagggaguucuuacccaaacuacacggcgcgacggcucuacccgaggccacaaggccacgguguccaccgggucaguccauuuuacaccuaagcugggaagaauccaguucagcacugauaccaguaacgacuuugaaacaggucagaauacuagguucaccccagugggcgucgugcaagaugggucuacaacccaccagaacgagccccagcaguggguuuugccggacuacuccggacgggauagccacaaugugcaucucgcuccugccguagcaccaucguuucccggcgaacaacuguuauucuuucguucuacuaugccugguuguuccggguaccccaacaugaaucuggacugccuccuuccacaggaguggguccagcacuucuaucaggaggccgcuccugcgcaaucagauguggcacuguugcgcuuuguuaaccccgacacgggcagagugcuauucgaauguaaacugcauaagaguggauacgucacaguggcccacaccggccagcacgaucucguaauuccaccgaauggguauuuuagguucgacagcugggugaaccaguucuacacucuggcuccuaugggaaacgguaccggccggcgacgcgcccuuuga

SEQ ID NO: 19315 - RNA, 1623 nt, Artificial Sequence
  derived and/or modified sequence opt3 from capsid_protein__Norovirus__ACL31313
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggggcgacggcagcacgcgcgggcacaaggccaccgugucuacaggauccguccauuuuacuccuaagcuggguucagugcaguucagcaccgauacaaguaaugacuuugagacuggccagaacacccgauucacaccagucggggugguucaagauggaucuaccacucaccagaaugaaccccagcaguggguguugccggcuuacuccggcagagacaaccacaauguacaucucgccccugcagucgccccaacguuucccggugagcaacuguuauucuuuaggagcacaaugccuggguguucgggcuaccccaacaugaaucuggauugccuccuuccacaggaaugggugcagcacuucuaucaggagucugcuccugcgcaauccgacguugcacuguugcgguuugugaaccccgauaccggacguguccuauucgaguguaaacugcauaagucaggcuacgugacuguagcccacaccgggcagcacgaccucgugaucccaccgaacggauauuuucgcuucgauaguuggguuaaucaguucuacacacuggcuccuauggguaacggcgccgggagaaggcgggcacuuuga

SEQ ID NO: 19316 - RNA, 1623 nt, Artificial Sequence
  derived and/or modified sequence opt3 from capsid_protein__Norovirus__ACL31316
augaagauggccagcuccgacgcuacccccucugauggcucaacagcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacuguuaguccaaggaacgcacccggggagauccuuuggagcgccccucugggaccagauuugaaucccuacuuaucccaccuggcucggauguauaacggcuacgccgguggguucgaagugcaggucauucuagcgggaaaugcauuuacggccggcaaaaucauuuucgcugccgugccuccaaacuuuccgaccgagggccucucucccucgcagguaacaauguucccucauaucauaguugacgugcgccaacuggagccaguccuuaucccccugccugaugugcgaaauaacuuuuaucacuacaaucagucaaacgacccaacuauuaaguugaucgcaaugcucuauacaccccugcgugcuaauaacgccggggaugacguguucaccgucagcugcagaguucugaccaggccgaguccugauuuugacuucauuuuucucgugcccccaacuguagaaucccggacaaaaccuuucucugugcccaucuuaaccgucgaggaaaugacgaacagccgcuuuccaauaccccuggagaaacuuuucacuggaccuuccucagcguucgugguucagccacagaaugguagauguaccacagauggcguguugcuggggacuacccaacuaaguccggucaacauuugcacauuuaggggagacgugacccauaucgccggcacgcagaauuacacuaugaaccucgcaagccagaauuggaacaauuaugaucccacagaggaaauuccugcuccacuggguacccccgacuucguagggaagauccagggaaugccuacucaaacaacccggggcgacggcucuacgcgcgggcacaaggccaccguuuccacaggaucagugcauuuuacuccaaaacuugguagcguccaguucaguaccgauacaucuaacgacuuugagacuggccagaauacccgauucacacccgugggggucgugcaagauggauccaccacucaccagaacgaaccgcagcaguggguucugccuaauuacagcggcagagacucgcacaacgugcauuuggcuccagccguagcacccacguuuccuggugagcaacuccuguucuuuaggucuacaaugcccggguguuccggcuacccaaauaugaacuuagauugccugcucccucaggaauggguccagcacuucuaucaggagucagcccccgcucaaagugacguggcgcuucugcgguuuguuaauccagauaccggacguguguuguucgaguguaagcuacauaagagcggcuacgucacuguggcacacaccgggcagcacgaccugguaaucccgccuaacggauauuuucgcuucgauuccugggugaaccaguucuacacacucgcccccauggguaauggcgcugggagaaggcgggcccuguga

SEQ ID NO: 19317 - RNA, 1623 nt, Artificial Sequence
  derived and/or modified sequence opt3 from capsid_protein__Norovirus__ACL31317
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagagacuuuucacgggaccuuccucagcguucgugguucagccacagaacgguagguguacuaccgauggcguguugcuggggacaacucaacuaaguccggucaauauuugcaccuuucggggagacgugacacauaucgccggcacccaggaguacacgaugaaccucgcaagccagaauuggaacaauuaugaucccacugaagagauuccugcuccacuggguacacccgacuucguagggaagauccagggaguucuuacccaaacuacacgccgagacggcucuaccagaggccacaaagccacgguguccaccgggucaguccauuuuacaccuaagcugggaaggauccaguucagcacugauaccaguaacgacuuugaaacaggucagaauacucgguucaccccagugggcgucgugcaagaugggucuacaacccaccagaacgagccccagcaguggguuuugccggacuacuccggacgugauggccacaaugugcaucucgcuccugccguagcacccagcuuuccaggugaacaacuguuauucuuucgcucgacuaugccuggguguucuggcuaccccaacaugaaucuggacugccuccuuccacaggaguggguccagcacuucuaucaggaggccgcuccugcgcaauccgauguggcacuguugagauuuguuaaccccgacacgggaagggugcuauucgaauguaagcugcauaaaucaggcuacgucacaguggcccacaccgggcagcacgaucucguaauuccaccgaauggauauuuucgguucgacaguugggugaaccaguucuacacucuggcuccuauggguaacggcaccgggcgacgcagagcccuuuga

SEQ ID NO: 19318 - RNA, 1623 nt, Artificial Sequence
  derived and/or modified sequence opt3 from capsid_protein__Norovirus__ACL31319
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcagguccuacucgcgggaaacgcauuuacugccggcaaaauuaucuucgcugccgugccuccaaauuuuccgacggagggccugucucccucgcagguaaccauguucccucauauuaucguugacgugcgccaacuugagccaguccugauacccuugccugaugugcgaaacaauuuuuaucacuacaaccagucaaaugacccaacaaucaagcucauugcaaugcuguauacuccccugcgugcuaacaacgccggggaugacguguucaccgucagcugcagaguucucacaaggccgaguccugauuuugacuucaucuuuuuagugcccccaaccguagaaucccggacuaaaccuuucucugugcccauucugacagucgaggaaaugaccaauagccgcuuuccaaucccccuugagagauuguucacgggaccuuccucagcguucgugguucagccacagaacgguagguguacuaccgauggcgugcugcuagggacaacucaacucaguccggucaauauaugcaccuuucggggagacgugacacauauugccggcacccaggaguacacgaugaaccuggcaagccagaauuggaacaauuaugaucccacugaagagaucccugcuccacuugguacacccgacuucguagggaagauucagggaguucugacccaaacuacacgccgagacggcucuaccagaggccacaaagccacgguguccaccgggucaguccauuuuacaccuaaguugggaaggauccaguucagcacugauaccaguaacgacuuugaaacaggucagaauacucgguucaccccagugggcgucgugcaagaugggggaacaacccaccagaacgagccccagcaguggguucucccggacuacucuggccgugauucccacaaugugcaucuggcuccugccguagcacccagcuuuccaggugaacaauuacuguucuuucgcucgacuaugccuggguguucuggcuaccccaacaugaaucucgacugccuucugccacaggaguggguccagcacuucuaucaggaggccgcuccugcgcaauccgauguggcauugcuaagauuuguuaaccccgacacgggaagggugcuguucgaauguaagcuccauaaaucaggcuacgucacaguggcccacaccgggcagcacgaucugguaaucccaccgaauggauauuuucgguucgacaguugggugaaccaguucuacacucuugcuccuauggguaacggcaccgggcgacgcagagcccuguga

SEQ ID NO: 19319 - RNA, 1623 nt, Artificial Sequence
  derived and/or modified sequence opt3 from capsid_protein__Norovirus__ACL31320
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagagacuuuucacgggaccuuccucagcguucgugguucagccacagaacgguagguguacuaccgauggcguguugcuggggacaacucaacuaaguccggucaauauuugcaccuuucggggagacgugacacauaucgccggcacccaggaguacacgaugaaccucgcaagccagaauuggaacaauuaugaucccacugaagagauuccugcuccacuggguacacccgacuucguagggaagauccagggaguucuuacccaaacuacacgccgagacggcucuaccagaggccacaaagccacgguguccaccgggucagucaacuuuacaccuaagcugggaaggauccaguucagcacugauaccaguaaugacuuugaaacaggucagaacacucgguucaccccagugggcgucgugcaagaugggucuacaacccaucagaaugagccccagcaguggguuuugccggacuacuccggacgugauagccacaacgugcaccucgcuccugccguagcaccaucguuucccggcgaacaacuguuauucuuucgcucuacuaugccugguuguuccggguaccccaauaugaaccuggacugccuccuuccacaggaguggguccagcauuucuaucaggaggccgcuccugcgcaaucagauguggcacuguugagauuuguuaaucccgacacgggcagggugcuauucgaauguaagcugcacaaaaguggauacgucacaguggcccauaccggccagcacgaucucguaauuccaccgaacggguauuuucgguucgacagcugggugaaccaguucuacacucuggcuccuaugggaaaugguaccggccgacgcagagcccuuuga

SEQ ID NO: 19320 - RNA, 1623 nt, Artificial Sequence
  derived and/or modified sequence opt3 from capsid_protein__Norovirus__ACL31322
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucgccggcacccaggaguacacgaugaaccucgcaagccagaauuggaacaauuaugaucccacugaagagauuccugcuccacuggguacacccgacuucguagggaagauccagggaguucuuacccaaacuacacggcgcgacggcucuacccgaggccacaaggccacgguguccaccgggucaguccauuuuacaccuaagcugggaagaauccaguucagcacugauaccaguaacgacuuugaaacaggucagaauacuagguucaccccagugggcgucgugcaagaugggucuacaacccaccagaacgagccccagcagugggcuuugccggacuacuccggacgggauagccacaauguucaucucgccccugcaguggccccaucguuucccggcgaacaacuguuauucuuucguucuacuaugccugguuguuccggguaccccaacaugaaucuggacugccuccuuccacaggaguggguacagcacuucuaucaggaggcugcgccugcacaaucagaugucgcccuguugcgcuuugugaaccccgacacgggcagaguucuauucgaauguaaacugcauaagaguggauacgugacagucgcucacaccggccagcacgaucucgugauuccaccgaauggguauuuuagguucgacagcuggguaaaccaguucuacacucuggccccuaugggaaacgguaccggccggcgacgcgcacuuuga

SEQ ID NO: 19321 - RNA, 1623 nt, Artificial Sequence
  derived and/or modified sequence opt3 from capsid_protein__Norovirus__ACL31324
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccuaucuuaacagucgaggaaaugaccaauucccgcuuucccauaccacuggagagacuuuucacgggacccucaagugcguucgugguucagccucagaacgguagguguacuaccgauggcguguugcuggggacaacucaacuaagcccagucaauauuugcaccuuucggggagacgugacacauaucgccggcacccaggaguacacgaugaaccucgcaucucagaauuggaacaauuaugauccgacugaagagauucccgcuccucuggguacaccagacuucguagggaagauccagggaguucuuacccaaacuacacgccgagacggcuccaccagaggccacaaagccacggugucaaccgggagcguccauuuuacacccaagcugggaaggauccaguucaguacugauaccucuaacgacuuugaaacaggucagaauacucgguucaccccugugggcgucgugcaagaugggggaacaacccaccagaacgagccacagcaguggguuuugcccgacuacuccggccgugauggucacaaugugcaucucgcuccggccguagcaccuagcuuuccaggggaacaacuguuauucuuucgcucgacuaugcccggcuguucuggauacccuaacaugaaucuggacugccuccuuccccaggaguggguccagcacuucuaucaggaggccgcuccagcgcaauccgauguggcacuguugagauuuguuaacccugacacgggcagggugcuauucgaauguaagcugcauaaaucaggguacgucacaguggcccacaccggacagcacgaucucguaauucccccaaaugguuauuuucgguucgacaguugggugaaccaguucuacacucuggcuccgaugggcaacgggaccggacgacgcagagcccuuuga

SEQ ID NO: 19322 - RNA, 1608 nt, Artificial Sequence
  derived and/or modified sequence opt3 from capsid_protein__Norovirus__ACL31325
augaagauggccagcaacgacgcugcacccuccaaugauggcgccgcggggcuggugccugaggucaacaaugaaaccauggcucucgagccaguugugggagccucuaucgcagccccgcuuacaggucagaacaauguaauugaccccuggauaagacugaacuucgugcaagcuccuaauggcgaauuuacugucucaccaaggaacagucccggggagguguuguuaaaucuggaacuaggaccugagcucaacccauaccuggcacaccuuagccggauguauaauggcuacgccggugggguugaggugcagguccuguuggcuggaacggccuucaccgcgggcaaacucguguuugcagccguacccccucauuucccacuggaaaacaucuccccgggccagauuacaauguuuccccacguuaucauugaugugcgcacucuggagccuguccucuuaccacugcccgacgugcgaaauaacuucuuucauuauaaucagcaaaacgaaccucguaugagacuuguggcuauguuguacaccccacugaggucuaacgggucgggagaugacgucuucacaguuucaugccgggugcuaacccgccccagcccggauuuugacuucaauuaucucguaccucccacuguggagaguaagacaaaaccauuuacccugccuauccuuacgauaggugagcugacuaacuccagauuccccgucccaaucgaugaauuguacaccucucccaaugagagccucgugguucagccucagaacgggaggugugcccuggacggcgaauuacagggaacaacucaacugcucccaaccgcaauuugcuccuuucggggccgcaucaaucagaaggugucaggugagaaccacgucuggaauaugcaagugacaaacauuaaugggaccccguucgaucccacggaagacguaccugcuccacuuggaacucccgauuucaguggcaaacuguuuggcguuuugagccagcgagaccaugccaacgcguguagaucucacgacgccgugaucgcaacaaauuccgcuaaguucaccccuaagcuaggggccauacagauuggaacuugggagcaggaugacguccacaucaaccagccaacaaaauuuacccccgugggucuguucgagaaugaaggcuuuaaccaauggacgcucccgaauuauucaggggcucugacccuuaacaugggacuggccccuccagucgcacccacauucccuggcgagcagauuuuguuuuucaggagccauaucccccucaagggugggguggccgauccaguuaucgacugccuguuaccucaggaauggauucagcaccuguaccaagagagugcucccucucagacugauguggcgcuaauacgguuuaccaacccagacacaggccguguacucuucgaagcaaaacugcaucgcuccggauacaucacugucgccaauaccggcagcagaccgauugugguuccugcuaacggguauuuuagguucgauucgugggugaaucaguuuuacucucuugcccccaugggaacagguaacggccggcgacgcguccaguga

SEQ ID NO: 19323 - RNA, 1629 nt, Artificial Sequence
  derived and/or modified sequence opt3 from capsid_protein__Norovirus__ACL31326
augaagauggccagcaacgacgcugcacccuccaaugauggcgccgcgucucuggugccugagggggucaacgaaaccaugccacucgagccgguugcuggagccucaaucgcagcccccguggcuggucagacaaauauuauagacccuuggaucagaacuaacuucguacaagcaccaaauggcgaauuuacggugagucccaggaacagcccuggggagauucuucugaauuuggaauuaggaccagaucugaaccccuaccuagcccaccucucccggauguauaauggcuacgcugguggggucgaggugcagguucugcuugccggaaacgcguucaccgcaggcaaaauccuguuugccgcuauuccuccaaauuucccgguggacaugaucucucccgcccagauaacaauguugccucaucucaucgucgaugugcgcacucuggagccaauuaugaucccccugccugacguacgaaacguguuuuaucacuucaauaaccagccacaaccccguaugagacucguugcaauguuauacaccccgcugaggucgaauggcucaggggaugacgucuuuacagugagcugccgggugcuuacccgcccuacucccgauuucgaauuuauuuauuuggucccaccuaguguugaguccaagacaaaacccuucacccugccaauccuaacgauaucugaacucacuaacagcagauuucccauuccuaucgagcagcuguacaccgcuccaaacgagacaaaugugguacagugucagaacggaaggugcacucuugacggugaacugcaaggcaccacacaguugcucuccucagccguguguaguuaucgggggcgcaccgucgcgaauagcggagauaacugggaccagaaucuguuacagcugacguacccgaacggcgccucuuacgaucccacugacgaggugccugcaccacucgguacacaagacuucuccgggaugcuuuauggaguucugacccaggauaaugugaacgucucaacuggcgaagcuaagaaugccaaaggcauuuacaucagcacaaccagugggaaguuuacgcccaagaucggaucuauugguuugcauuccauaaccgagcacgugcauccuaaccagcaaagccgauucacaccaguaggcguugcugugaaugaaaacacucccuuccagcaguggguccuaccgcacuaugccgggucgcuggcacucaauaccaaccuggccccugcuguggcgccaacauuucccggagagcagcuucuguucuuuagaucuagggucccuugcgugcaaggcuugcagggucaggacgcauucaucgauugucuccugccccaggaguggguuaaucacuuuuaccaagaagccgcuccaucccaggccgacguggcauuaauucgguauguaaacccugauacugggcguacccuguucgaggccaaacuacaucgcucaggcuuuaucacagucagucacaccggagcuuacccccucgugguuccaccgaacggccauuucagauuugacagcugggugaaucaguucuauucccuggccccuauggggacuggaaacgguaggcggcgaguccaguga

SEQ ID NO: 19324 - RNA, 1623 nt, Artificial Sequence
  derived and/or modified sequence opt3 from capsid_protein__Norovirus__ACL31340
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccugucccggauguauaauggcuacgcugguggguucgaagugcaggucauucuagccggaaacgcguuuacggcaggcaaaaucauuuucgccgcugugccuccaaauuuuccgaccgagggccucucucccucgcagguaacaauguucccucauaucauaguugacgugcgccaacuggagccaguccuuaucccccugccugaugugcgaaacaauuuuuaucacuacaaccagucaaaugacccaacuauuaaguugaucgccaugcucuauacaccccugcgugcaaacaacgcuggggaugacguguucaccgucagcugcagaguucugaccaggccgaguccugauuuugacuucauuuuucucgugcccccaacuguagaaucccggacaaaaccuuucucugugcccaucuuaaccgucgaggaaaugacgaauagccgcuuuccaauaccccuggagaaacuuuucacuggaccuuccucagccuucgugguucagccacagaacgguagauguaccacagauggcguguugcuggggacuacccaacuaaguccggucaauauuugcacauuuaggggaaacgugaccaauaucgcgggcagccagacguacacuaugaaccucgccucucagaauuggaacaauuaugaccccacagaggaaauuccugcaccacuggguacccccgauuucguagggaagauccagggaguucuuacucaaacaaccaagggcgacggcuccacgcgggggcauaaggcuaccgugucaacaggaagcgcccaguuuacuccuaaacuggguaguguccaguucucuaccgacacauccacugauuuugagaccggccaaaacacacgcuucaccccagugggggucauccaggacggaagcacuacgcacaagaaugaaccccagcaguggguguugccgucguacucuggccgagauucccauaacguucaccucgcuccugccguggcaccaacauuucccggugagcaaauucuguucuuuagaucaaccaugccuggguguaguggcuaccccaauauggacuuagauugccugcucccacaggaauggguacagcacuucuaucaggagagcgccccugcucaauccgacgucgcgcuucugagguuugugaaccccgauacuggacggguuuuguucgaguguaaacuacauaagucuggcuacgugaccgucgcacacacagggcagcaugaccuggugauaccaccgaauggauauuuucguuucgauagcuggguaaaccaguucuacacccucgccccuauggguaacggcgcugggcgcagaagggcccuguga

SEQ ID NO: 19325 - RNA, 1623 nt, Artificial Sequence
  derived and/or modified sequence opt3 from capsid_protein__Norovirus__ACL31354
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccaguugaaugacucaaccauuaagcucaucgcuaugcuguauacaccacugcgugccaacaacgcgggggaagauguguucacugucagcugcagaguucucaccaggcccaguccggacuuugauuucauuuuucuggugccucccacaguagagucccggaccaaaccauucacugugccuauccugacagucgaagagaugaccaauucucgcuuucccauaccacuugagaaguuguucacgggacccagcggugccuucgugguucagccucagaacggcagauguacuaccgacggggugcugcuaggaacaacucaacucuccccagucaauauuugcaccuuuaggggcgaugugacacauaucgcagguucacgggacuacaccaugaaccuggcuagucuuaauuggaacaauuaugauccgacggaagagauucccgccccucuggggacuccagacuucguaggaaaaauccagggcguuuugacacagaccacuaagggcgacgggagcacacgcggacacaaggcuaccguguacacggguucugcccccuuuaccccuaaacucggcuccguccaguucucaacagauacugaaaacgacuuugagacccaucaaaauacaaaguucacuccagugggggucauccaggauggaagcaccacacaccgaaacgaaccccagcaaugggugcugccgaguuacucuggcagaaauguucacaacgugcauuuagccccugcaguagcuccaaccuuucccggugagcaguuacucuucuuuagguccacuaugccuggguguagcggcuaucccaauauggaccuugauugccuguugccacaggaguggguccagcacuucuaccaagaagcggccccugcacagucggacguggcucuacugcgguuuguuaaccccgauacgggacguguccucuucgaguguaaacugcauaagucuggcuaugugacaguggcccacaccgggcagcacgaccuuguaauuccaccgaauggauacuuucgcuucgauuccugggugaaccaguucuauacucuggcaccuauggguaacggcaccgggagaaggcgggccuuguga

SEQ ID NO: 19326 - RNA, 1623 nt, Artificial Sequence
  derived and/or modified sequence opt3 from capsid_protein__Norovirus__ACL31355
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucggaacuacaccaugaaucucgcuagccugaacuggaauaacuaugacccgacggaagagauucccgccccucuugggacuccagauuucguaggaaagauccagggcguucugacacagaccacuaagggcgacgggucuacacgcggacacaaggcuaccguguacacggguuccgcccccuuuaccccuaaauugggcucaguccaguucagcacagacacugaaaaugauuuugaggcacaucaaaacaccaaguucacaccagugggggucauccaggacggaggcacuacccaccgaaaugaaccccagcaaugggugcucccgaguuacucugguagaaacguucacaaugugcaucuggccccugcuguagcgccaacauuucccggggagcaguuacuguucuuuagguccaccaugccuggcuguagcggauaucccaacauggaucucgacugccuucugccacaggaguggguccagcacuucuaccaagaagcagccccugcucagucggauguggccuugcuacgguuuguuaaucccgacacuggccgugugcuguucgaguguaaacuccauaagucuggguaugucacgguggcacacacaggacagcacgaucugguaauuccaccgaacgguuacuuucgcuucgacuccugggugaaccaguucuauacccuugccccuaugggcaaugggacuggaagaaggcgggcucuguga

SEQ ID NO: 19327 - RNA, 1623 nt, Artificial Sequence; identical to SEQ ID NO: 18102
  derived and/or modified sequence opt3 from capsid_protein__Norovirus__ACL31356

SEQ ID NO: 19328 - RNA, 1623 nt, Artificial Sequence
  derived and/or modified sequence opt3 from capsid_protein__Norovirus__ACL31358
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugauccauauugcagguagucggaacuacacaaugaaucucgcuagccugaacuggaauaacuaugacccgaccgaagagauccccgccccucuugggacgccagauuucguaggaaagauccagggcguucugacucagacaaccaagggcgacgggucuacucgcggacacaaggcuacaguguacaccgguuccgcccccuuuacgccuaaauugggcucaguccaguucagcaccgacacagaaaaugauuuugaggcacaucaaaacacuaaguucaccccagugggggucauucaggacggaggcacaacucaccgaaaugaaccccagcaaugggugcucccgaguuacucugguagaaacguucacaaugugcaucuggccccugcuguagcgccaaccuuucccggggagcaguuacuguucuuuagguccacaaugccuggcuguagcggauaucccaacauggaucucgacugccuucugccacaggaguggguccagcacuucuaccaagaagcagccccugcucagucggauguggccuugcuacgguuuguuaaucccgacaccggccgugugcuguucgaguguaaacuccauaagucuggguaugucacuguggcacacacgggacagcacgaucugguaauaccaccgaacgguuacuuucgcuucgacuccugggugaaccaguucuauacacuugccccuaugggcaaugggaccggaagaaggcgggcucuguga

SEQ ID NO: 19329 - RNA, 1647 nt, Artificial Sequence
  derived and/or modified sequence opt3 from capsid_protein__Norovirus__ACL31361
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugauugccaugcuguacacuccccucagagcaaauaacucuggagaugacguuuucacagugucguguagggucuuaacucggccuucaccagauuuuagcuucaauuuucuggugcccccgaccguggagaguaagacaaaaccuuucucccuucccaucuugaccauaucugaaaugagcaacucccgcuuuccagucccuauugacucacugcauaccagucccacagagaauaucguugugcagugccagaacgguagaguaacccuagauggcgagcucauggggacgacucaacugcuuccaagccagauuugugcuuucaggggagugcugacccggucuacaucccgcgccucagaccaggcugauacugccacaccccgauuguucaauuauuacuggcacauccagcucgacaaccugaauggcaccccuuaugacccagcagaagauaucccgggucccuuagggaccccugacuuuagaggaaaggucuucggcguggccagccaaaggaacccagauaguacgacucgggcucaugaggcgaaaauugacacaaccucuggccguuuuacucccaagcuggggucccucgaaauaagcacagagucggaugacuucgaucagaauaagccuacccgcuuuacgccaguuggaaucgguguggaccacgaagcagauuuccagcaaugggcccuucccgacuacgcuggccaguuuacccacaacaugaaucuggccccggcagucgccccuaacuucccaggggagcaguugcuauuuuucagaucucagcugcccuccucaggaggcaggaguaaugguauucucgauugccuggugccucaagaguggguacagcauuuuuaccaggaaagcgcucccucccagucucaaguugcccuugugcgguauaucaacccagacacagggcgaguccuguucgaggcaaaauugcacaagcucggcuuuauaacuauugcgaaaaacggagacagcccuaucaccgugcccccaaauggcuacuuccgcuucgaaucaugggucaacccguuuuauacacuggcuccuauggggacuggaaaugguagaaggcggauccaguga

SEQ ID NO: 19330 - RNA, 1623 nt, Artificial Sequence
  derived and/or modified sequence opt3 from capsid_protein__Norovirus__ACL31365
augaagauggccagcaacgacgcuaaucccuccgauggcucugcagccaaccuggugccugaggucucaaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccggugccuucgugguucagccucagaacggcagauguacuaccgacgggguguugcugggaacaacucaacuaucaccagucaauauuugcaccuuuaggggcgaugugacacauaucgcagguagucacaacuacaccaugaaucucgcuagccugaacuggaauaacuaugacccgacggaagagauucccgccccucuugggacuccagauuucguaggaaagauccagggcguucugacacagaccacuaagggcgacgggucuacacggggacauaaggcuaccguguacacggguuccgcccccuuuaccccuaaauugggcucaguccaguucagcacagacacugaaaaugauuuugagacccaccaaaacacaaaguucacuccagugggggucauccaggacggaaguaccacacaccgcaaugaaccccagcaaugggugcucccgucuuacuccggcagcaacguucauaaugugcaccuggccccugcaguagcuccaaccuuucccggugagcaguuacuguucuuucgaucgacuaugccuggguguucuggcuaucccaacauggaucucgacugccuucugccacaggaguggguccagcauuucuaccaagaagcggccccugcacaguccgauguggcuuugcuaagauuuguuaaucccgacacgggaagggugcuguucgaguguaaacuccacaagucaggcuaugucacaguggcccacaccgggcagcaugaucugguaauuccaccgaacggauacuuucgguucgacaguugggugaaccaguucuauacucuugcaccuauggguaauggcaccgggcgucgcagagcccuguga

SEQ ID NO: 19331 - RNA, 1623 nt, Artificial Sequence
  derived and/or modified sequence opt3 from capsid_protein__Norovirus__ACL36375
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacccaaccauuaaguugaucgcuaugcucuauacaccccugcgugccaacaaugcgggggaagauguguucacugucucaugcagaguucugaccaggccgagcccugacuuugauuucauuuuucucgugcccccaacaguagagagucggaccaaaccuuucacugugcccaucuuaacagucgaagagaugaccaacucccgcuuuccaauaccccuggagaaacuuuucacgggaccuucuagcgccuucgugguucagccacagaaugguagauguacuaccgacggcguguugcuggggacaacucaacuauccccggucaacauuugcaccuuuaggggagaugugacacauaucgcaggcucacggaauuacaccaugaaccucgcuagucugaauuggaacaauuaugaccccacggaagagguaccugccccacuugguacucccgauuucguugggaagauucagggagugcugacacagaccacuaagggcgacggcagcacacgcgggcacaaggcuaccgucuacacgggaucugccccuuuuaccccaaaauuggguuccgugcaguucucaacagacacugaaaacgauuuugagacccaucaaaauacaaaguucacucccgucggcgugauccaggacgggagcaccacacaccgaaacgaaccgcagcaauggguucucccuaguuacucuggaagaaaugugcagaacguacaccuggcaccagccgucgcucccaccuuuccuggcgagcaguuacuguucuuuagguccacuaugcccgguuguagcggguauccaaauauggaucucgacugccuucugccucaggagugggugcaacauuucuaccaggaagcggcacccgcccagucggauguugcuuugcuacgguuugugaacccagacacgggccguguccuguucgaguguaaacuccacaagucuggauaugugacaguagcccauaccggccagcacgaucuggugaucccgccuaacggguacuuucgcuucgacuccuggguuaaucaauucuauacucuugcacccaugggaaacgguaccggcagaaggcgggcccuguga

SEQ ID NO: 19332 - RNA, 1593 nt, Artificial Sequence; identical to SEQ ID NO: 19245
  derived and/or modified sequence opt3 from capsid_protein__Norovirus__ACN32270

SEQ ID NO: 19333 - RNA, 1608 nt, Artificial Sequence
  derived and/or modified sequence opt3 from capsid_protein__Norovirus__ACT52403
augaagauggccagcaacgacgcuucccccucuucagauggcagugcaaaucuggugccugagaucaacaaugaagucauggcccucgagccaguugcgggggcugccauugcagccccgguggcuggacagcaaaacauaaucgaccccuggauuagaaauaacuucguacaggcaccugguggcgaauuuaccgugagcccaagguccgcccccggggagguccuucugaauuugccuuuaucuccagauaucaaccccuaccuggcucaccuaucgcggauguauaauggauacgccggcgguguggaaguugaggugguccucgcggggaacgcauucacagccggaaaaauuaucuuugcugccgugccuccaaauuucccgcccgagaaccugucaccuagccagauaacuaugcuuccacauaucauuguagacguucgccagcuggaacccgugcgaaucccuuugccagauguccguaauaacuuuuaucacuacaguagagagaaugacuccacgcucaggcugauugcaaugcuguauaccccucuccgggcuaacaacgccggcgaugacguguucacagugucuugccgcgucuuaacuagaccgagcccugauuuugacuucaucuuucugguucccccaaccguggaauccaagucaaaaccuuucacaauacccauucuuaccaucgaggagaugacuaauaguagguuuccagcgcccuuggaaaugaugacaaccggcccuagccaugauauuguagugcaaccacagaacgggcgguguacgaucgacggaguccugcuagguacuacccagcucucuccggugaauaucugcuccaugcgcggcguucccacaaagcgaacuaacgggaccgauaauuguuucgugcagcuggagaacccuaauggaucagccuacgacccaacagaagacauucccgcaguccuuggcagcccugauuuugugggugaguucuaugggaccauaacgcaaagaaguccaaacaauucuacuagggcucaccccuucacacugaacaccggauccccgcgguacacuccuaaaaucggcagcguagacauucauguuacagauguggaagacuugaaugaucacgagccagucaagcucacccccgugggccugucggggucuuccggaucaauccaccaguggcaguuaccuaacuacaguggugucgccacgcauaauaugcaccuggcucccagcguggccccacucuuuccuggcgagcagauacuuuucuuucguuccaccguucccgggugcggaggcuauccaaacacaaauauugacugucugaucccgcaagaaugggugcagcauuucuaccaggagggugcacccgcccgcacugauguagcuuugcuaagauuuaucaaccccgacaccgggaggguccuguucgaaugcaagcuccacaaacacggcuuuauuacaguggcguauucuggaaaccaugaucugguuaugccacccaauggcuacuuccgguuugagagcugggugaaccaauuccacacucuugcaccuauggggaccggaucaggucgacgcagaauccaguga

SEQ ID NO: 19334 - RNA, 1647 nt, Artificial Sequence
  derived and/or modified sequence opt3 from capsid_protein__Norovirus__ACT52405
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuauggacaauuucguucaggccccuggcggggaguuuacugugucuccaagaaacucacccggagaaguacuguugaauuuagagcugggcccugaaaucaacccauaccuagcucaccucgccaggauguauaaugguuacgcagggggauucgaggugcaggucgugcuggcgggcaacgccuuuacggcuggcaaaauuaucuucgccgcaauacccccuaauuuuccaaucgauaaccuuagugcugcccagauuaccaugugcccgcauguuaucguggacguccggcaacuggagcccgugaauuugccuaugccagauguacgcaacaauuucuuucacuauaaccaggggagcgacucccgacuccgucugauugcgaugcuguacacaccccucagagccaacaauucuggagaugacguuuucacugugucguguagggucuuaacccggccuucaccagauuuuagcuucaacuuucuggugcccccgacaguggaaaguaagaccaaaccuuucacucuucccaucuugacaauauccgagaugucuaauagccgcuuuccagucccuauugacucccugcauaccucacccacggauaacaucguugugcagugccagaaugguagaguaacucuagacggcgaacucauggggaccacacaacugcuuccaagucagauuugugcauucaggggagugcugacucggagcaccucucgcgcuuccgaccaggccgauacagcuacgccccgauuguucaacuauuacuggcacauccagcucgacaaucugaacggcaccccuuaugauccagccgaggacaucccgggucccuuagggacuccugauuuuagaggaaaggucuucggcguggcaucacaaaggaauccagacagcacaacccgggcccaugaggcuaaaguugauacuacagcgggccguuuuacccccaagcuggggagucucgaaauuucuacggaguccaacgacuucgaucagaaucagccuacccgcuuuacaccagugggaauaggugucgaccacgaagcagauuuccaacaguggagccuucccgacuacucgggccaguuuacucacaacaugaaucuggugccggccguagcuccuaacuucccaggggagcaguugcuauuuuucagaucucaacugcccuccucaggaggcaggaguaaugguauccucgacugccugguuccucaggaaugggugcagcauuuuuaccaggagagcgcccccgcacaaacccaggucgcccuugugcgguaugucaacccagauacagggcgagugcuguucgaggcuaaguugcacaaacucggcuuuaugacuauugccaagaacggagacuccccuaucaccguucccccaaauggcuacuuccgcuucgaaucuugggugaacccguuuuauacacuggcaccuauggggaccggaaaugguagaaggcggaaccaguga

SEQ ID NO: 19335 - RNA, 1647 nt, Artificial Sequence
  derived and/or modified sequence opt3 from capsid_protein__Norovirus__ACT52407
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuaagucaccucgcuaggauguauaacgguuacgccgggggauucgaggugcaggucgugcuggcgggcaaugcauuuacggccggcaaaauuaucuucgcugccauacccccuaacuuuccaaucgacaaucuuagcgcagcucagauuaccaugugcccgcauguuaucguggauguccggcaacuggagcccgugaacuugccuaugccagacguacgcaauaacuucuuucacuauaaccagggguccgauucucgacuccgucugauugccaugcuguacacaccccucagagcgaauaacucgggagacgauguuuucacugugucauguagggucuuaacccggccuagcccagacuuuaguuucaauuuucuggugcccccgacaguggaauccaagaccaaaccuuucacucuucccaucuugacaauaucugagaugagcaacucccgcuuuccagucccuauugauucacugcauaccagucccacggaaaauaucguugugcagugccagaacgguagaguaacucuagacggcgagcucauggggaccacacaacugcuuccaagccagauuugugccuucaggggagugcugacucggucuaccucccgcgcaucagaucaggcugacacagccacgccccgauuguucaauuauuacuggcacauccagcucgacaaccugaauggcaccccuuaugauccagcugaggacaucccgggucccuuagggacuccugauuuuagaggaaaggucuucggcguggccagccaaaggaacccagacaguacaacccgggcacaugaagccaaaguugauacuacagcuggccguuuuacccccaagcuggggucucucgagauuuccacggaaagcgacgauuucgaccagaaucagccuacccgcuuuacaccagugggaauaggugucgaucacgaggcggacuuccaacaguggucgcuucccgauuacucuggccaguuuacucacaacaugaaucuggcaccggccguggcuccuaacuucccaggggaacaguugcuauuuuucagaucccaacugcccucaaguggaggcaggagcaaugguauccucgacugccugguaccucaggaguggguucagcauuuuuaccaggaguccgcccccgcacaaacccagguggcccuuguccgguaugugaacccagacacagggcgaguccuguucgaagcuaaguugcacaaacucggcuuuaugacuauugccaagaacggagauucuccuaucaccgugcccccaaauggcuacuuccgcuucgagagcuggguuaacccguuuuauacacuggcaccuauggggaccggaaaugguagaaggcggaaccaguga

SEQ ID NO: 19336 - RNA, 1608 nt, Artificial Sequence
  derived and/or modified sequence opt3 from capsid_protein__Norovirus__ACT52409
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagaaugaacuucguacaagcaccuaauggcgaauuuacugugucaccaaggaacagucccggggagauccuguugaauuuagaacugggaccugagcuaaacccauuccucgcccaccugagccggauguacaauggcuaugcugguggggucgaggugcagguucuucuggccggaaacgcguuuacggcaggcaaauugguguucgccgcuauucccccucauuuuccaaucgaaaaucucuccccgggccagauuaccauguucccccacgucaucauagaugugcgcacacuggagccuguacugcucccauuacccgacguucgaaacucguuuuuccauuacaaucaggaaccugagccacguaugagacugguggccaugcuuuauacucccuugaggucuaacgggucaggagaugacgucuuuaccgugagcugccgggugcugacacgcccgaguccugauuucgacuuuaacuaccuaguucccccaaccgucgaguccaagacuaaaccuuucacacuccccauccugaccauuggugaacuuucuaauagcagauuuccagcacccaucgaugagcuguauacguccccuaacgaaggcuuggugguacaaccacagaaugggaggucaacucucgacggagagcuguuaggcaccacacagcuggugccgaguaacauuuguagccuccggggucgcacuaaugcucaccuucccgauaaccagcaucgauggaauaugcaagucaccaacccuaaugggacaccauucgaccccaccgaagaugugccugccccacugggaacgcccgacuucuuggcgaacaucuacggcguuacuucucagagaaauccgaacaauacaugcagggcccacgacggcauacuagcaaccugguccccuaaguuuacuccaaaacuggggucagugguccucggaacaugggaggaucgggacuucgauauuaaccagcccacccguuuuacgccugugggucuguaugacaccgaucacuucaaucagugggcccuucccaacuacagcggcgcucugacauugaacaugaaucucgcuccaaguguagccccucuguuucccggggagcaauuacuguucuuucgcucucauaucccacuaaagggaggcacuuccaacggugcaauugacugucuccugccgcaggaauggguucagcacuucuaccaagagagcgccccuucgucuaccgauguggcucuuaucagauauacaaaucccgacacugggagggucuuguuugaagcgaagcugcaucggcagggcuucaucaccguguccaacucaggaagucgaccaauugucgugcccccuaauggcuacuuucgcuucgauagcuggguuaaccaguuuuauucccucgcaccaauggggacaggaaaugguagaaggcgggugcaguga

SEQ ID NO: 19337 - RNA, 1623 nt, Artificial Sequence
  derived and/or modified sequence opt3 from capsid_protein__Norovirus__ACT78459
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccaucuuaacagucgaggaaaugaccaauagccgcuuuccaauaccccuggagaaacuuuucacgggaccuuccucagcguucgugguucagccacagaacgguagauguacuaccgauggcguguugcuggggacaacucaacuaaguccggucaauauuugcaccuuuaggggagacgugacacauaucaccggcagccggaacuacacgaugaaucucgccacucagaacuggaacucuuaugaucccacagaggaaauuccugcaccacuggguacccccgacuucguagggaagauccagggaguucuuacucagacaacccgcgcugacggcuccacgcgaggccacaaggccaccguguacacagggucagcugauuuugccccuaagcugggaagaguccaauucgcaacugacaccgaucaugacuuugaugccaaucagaauacaaaauucacuccagugggugucauccaggacggcgauaccgcucacaggaacgagccccaacaguggguguugccgagcuacagugggcguaauucucacaacguucaucucgcgccugcaguggccccaacauuucccggagaacagcuguuauucuuucgguccaccaugccuggcuguagcgguuaucccaauauggaccuggauugccuccuuccacaggaguggguacaauacuucuaucaggaagcugccccugcacagucggacgucgcccuguugcgcuuugugaaccccgauacugggagaguucuauucgaguguaagcugcacaaaucuggcuacgugacggucgcucauacaggacagcacgaccucgugauuccaccgaauggcuauuuuagguucgacuccuggguaaaccaauucuacacccuggccccuauggggaacggaacuggucggcgacgcgcacuuuga

SEQ ID NO: 19338 - RNA, 1641 nt, Artificial Sequence
  derived and/or modified sequence opt3 from capsid_protein__Norovirus__ACU56258
augaugauggccagcaaggacgcuccccaguccgcagauggcgccucuggggcgggacaacuggugccugaggucaacaccgcugacccacucccgauggaacccguugccgguccuacaacugcaguggccacggcuggccagguaaauaugaucgauccauggauugugaacaauuucguccagucaccccagggggaguuuaccauaaguccuaacaauacaccaggagacauccuuuucgaucugcaauugggcccccacuuaaacccuuuucugagccaucuaucccagauguacaaugguuggguggggaacaugagaguuaggauucuccuggcaggaaaugccuucucugcuggcaaaaucauugugugcugugucccaccgggcuuuacuucgucaagccuuaccaucgcccaggcgacacuguucccccacgugauagcagacguacggaccuuggaaccuaucgagaugccacucgaagauguucgcaacgugcuguaucauacuaaugacaaccagcccacaaugcgacuggucugcaugcucuacaccccuuuacguacugggggagguaguggcaauuccgauucuuuugugguggccgggagaguccugacggcuccaagcuccgacuucucauuucuuuucuugguucccccgaccauugagcaaaagacaagggccuuuacugugccuaacaucccccugcagacccuaaguaauagccgguucccaucucucauucagggaaugauccuguccccugaugcaucacagguagugcaauuucagaacggccgcugucuuauagacggucagcuguuggggacaacccccgcuacgagcggacaacucuucagagucaggggcaaaauuaaccagggcgcccggacucugaauuuaacagagguggaugggaagccauucauggcguuugacagucccgccccuguuggauucccagacuuugguaaaugcgauuggcacaugcgcaucucuaagaccccgaacaauacuuccagcggcgaccccaugcgaucgguggauguccagacagacgugcagggguucguaccucaucugggaucuauucaauuugaugaaguuuucaaccacccaaccggcgacuauaucgguacgaucgaguggauuucccagcccucaaccccuccagggacagauauaaaucucugggaaauccccgacuacggcaguagccuuucccaggcagcuaaccuggccccgccuguguuuccacccggauucggcgaggcuuuggucuauuuugugucugccuucccugggcccaauaacagaagcgcaccaaaugaugucccuugucuacugccccaggaguacgugacucacuuuguuucagaacaagccccaaccaugggagacgcugcgcuccugcauuauguggauccggacacaaacaggaaucuuggugaguucaagcuguacccuggcggguacuugacuugcguacccaacggagucggcgcagguccacagcagcucccccugaaugggguguuuuuauucguuaguugggugucccgguucuaucagcugaaaccugucggcaccgccagcacagcucguggacgccuaggcgugagaaggauuuga

SEQ ID NO: 19339 - RNA, 1638 nt, Artificial Sequence
  derived and/or modified sequence opt3 from capsid_protein__Norovirus__ACX33982
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauguacucuuugaccuucagcugggcccucacuugaauccauucuuaagucaucuggcccaaauguauaacgguuggguggggaauaugaaagucaaggugcuacucgcgggaaacgcauuuaccgccggcaaaauuaucauuagcugcauacccccuggcuucgcugcccagaauuuuuccaucgcacaggcuacaauguucccacacguuaucgccgaugugagaguccuggaaccgauugaagugccccuugaggacguaaggaacguucuguuucauaauaacgauaauaccccuacuaugcgguugguguguaugcucuacacaccacugcgcgcgucugggucgucaagcggaaccgaccccuucgucaucgccggucgagugcugacgugcccuaguccagauuuuuccuuccucuuuuuagugcccccgaacgucgagcagaagacuaaaccuuucucuguucccaaccugccacuuaauaccuugagcaacucccgugugccuucacugauuaagaguaugaugaucagcagagaccacggccaaaugguacaguuucagaaugggagggugacacuagauggacagcuccaaggcacuacccccacaucugcaucccagcuguguaagauacgggguucagucuuccaugcuaacgggggaaauggcuauaaccuuaccgaacuggacggcagcccauaccacgccuucgagagucccgcuccuauuggguuuccagauuugggagaaugcgacuggcacauggaggccucuccgaucacgcaguucgacacuggugaugugauuaaacaaaucaauguuaagcaggaguccgcauuugcuccccaucucggcacagugcaggccgacgggcugagcgaugucucggcgaacaccaauaugaucgcaaaauuaggaugggugucuccuguauccgacggccaccgcucagauguugacccaugggugauucccagauaugguaguacucugacagaagccgcucagcucgccccuccaauauaucccccgggguucggcgaggcaaucgucuuuuucaugagcgauuuuccuauugcccauggaaccaacggccuuuccgugccauguacgaucccccaagaguucgucacccacuuugugaaugaacaggcuccuacaaggggagaagccgcacuguugcacuaccuagaccccgauacucaucggaaccugggggaguucaagcucuacccagacgguuuuaugaccugcguuccuaauucuagcggcacagggccccagacucugccaauaaacggaguguucguauuugucucaugggugagucgcuucuaccagcuuaaaccgguuggcaccgcggguccugcucgaagacuggggauuaggcgguccuga

SEQ ID NO: 19340 - RNA, 1638 nt, Artificial Sequence
  derived and/or modified sequence opt3 from capsid_protein__Norovirus__ACX33983
augaugauggccagcaaggacgcucccaccaacauggauggcacauccggggcaggacagcuggugccugaggccaauacugcggaaccaaucucuauggagccggucgcuggugccgcaacggccgcugcaaccgccggccaaguuaacaugauugaccccuggauaaugaauaacuacgugcaggcuccucagggggaguucacaaucucaccaaauaacacucccggagauguacucuuugaccuucagcugggcccucacuugaauccauucuuaagucaucuggcccaaauguauaacgguuggguggggaauaugaaagucaaggugcuacucgcgggaaacgcauuuaccgccggcaaaauuaucauuagcugcauacccccuggcuucguugcucagaauuuuuccaucgcccaggcaacaauguucccacacgugaucgcugaugucagagugcuggaaccgauugaaguaccccuugaggacguuaggaacgugcuguuucauaauaacgauaauaccccuacuaugcgguuggucuguaugcucuacacaccacugcgcgccgggggaucuucgucagguaccgaccccuucgugaucgcgggccgagugcugacgugcccuagcccagauuuuaguuuccucuuuuuaguucccccgaacgucgagcagaagacuaaaccuuucuccgugcccaaccugccacuuaauaccuugucuaacagccguguaccuucccugauuaagucaaugaugaucaguagagaccacgggcaaauggugcaguuucagaauggaagggucacacuagauggccagcuccaagguacuacccccacaagcgccucucagcuguguaagauacggggguccguguuccaugcaaacggaggcaauggcuauaaccuuaccgaacuggacgggucaccauaccacgcuuucgagagccccgccccuauuggauuuccagauuugggugaaugcgacuggcacauggaggcuaguccgacgacucaguucgacacaggcgauguuaucaaacaaauuaaugugaagcaggagucugccuuugcaccccaucucgggaccguccaggccgacggacuguccgaugugagcgcuaacacuaauaugaucgcgaaauuaggcuggguaucgccuguuucugacggucaccgcuccgauguggacccaugggucauccccagauaugggucaacacugaccgaagcagcccagcucgcuccuccaauuuaucccccgggcuucggagaggccauaguguuuuucaugagugauuuuccuaucgcacauggcacgaacgggcuuagcgucccauguaccauuccccaagaguucgugacacacuuuguuaaugaacaggccccuacuaggggagaagcugcccuguugcacuaccuagaccccgauacccaucggaaccugggugaguucaagcucuacccagacggcuuuaugacaugcgugccuaauuccucugggacuggaccccagacccugccaaucaacggcguauucgucuuugugagcuggguuucacgcuucuaccagcuuaaaccgguggguacagcagggccugcgcgaagacugggcauaaggcggaguuga

SEQ ID NO: 19341 - RNA, 1611 nt, Artificial Sequence
  derived and/or modified sequence opt3 from capsid_protein__Norovirus__ACX81341
augaagauggccagcaacgacgcuacccccuccgaugacggcgcagccgggcuggugccugagaucaauaacgaagucauggcgcucgagccaguugcuggagccucuauugcagccccggugguaggucagcaaaauauaaucgaucccuggauuagaaacaauuucgugcaggcuccugcaggcgaauuuacagucucaccaaggaacagucccggggagcuucuguuggacuuagaacugggaccugagcuaaauccauaccucgcccaccuggcucggauguauaacggccaugccggugggauggaggugcagaucguucuugcgggaaaugcauucacugccggcaaaauucuguuugcugccauacccccuagcuucccauacgaaaacuuguccccggcacagcucacgaugugcccccacgugaucgucgaugugcgccaacuggagccuguacugcucccaaugcccgacauccgaaauguguuuuaucauuacaaccagaauaacucuccuaaguuacgucugguugcuaugcuuuauaccccauugagagccaauaacucgggcgaugacgucuucacagugucauguagggugcugacucggcccagcccggauuuucaguucaccuuucuagucccucccacaguugaaaguaaaaccaagaacuucacucucccagugcugcgcguauccgagaugacaaauucuagauuuccugugguccuugaccagauguacaccagcaggaacgagaauauuaucgugcaaccccagaacgggcggugcacgacugauggagaacuguuggguaccacaauucuccaguccguuucaaucuguaauuucaaaggcacuaugcaggcgaagcugaacgaggaaccacgcuaucaauuacagcugaccaaucucgacgggagucccauagauccuacagacgacaugccagccccgcuuggaacccccgauuuucaggcaaugcuguacggcguggcuagccaacgaucuuccauugacaacgccacgagagcucacgaugcccagaucgacacugccggugauacauucgcaccuaagauugggcaggucagguucaaaucaagcaguaaugacuuugauuugcaugacccaaccaaguucacucccaucggagugaacguagaugaccagcacccuuuucggcaauggucucuaccaaauuacggcggccaccuggcucucaacaaucaucuggcgcccgcaguuacaccgcuuuucccuggggagcagauccuguuuuuccguuccuauauuccaagcgccggaggucacaccgauggcgcuauggacugcuugcucccccaggaauggguggagcauuuuuaccaggaggccgcaccuucgcaaucugacauagcccugguccgcuucaucaaccccgauacggggagaguguuauuugaagcuaaacugcacaagcagggauuccuaaccauugccgcauccggcgaccacccaaucgucaugccuacaaaugguuauuuuagguucgaggcgugggugaaccccuuuuacacucucgcuccaguugggaccggcucaggacggcgacgcauacaguga

SEQ ID NO: 19342 - RNA, 1611 nt, Artificial Sequence; identical to SEQ ID NO: 19341
  derived and/or modified sequence opt3 from capsid_protein__Norovirus__ACX81343

SEQ ID NO: 19343 - RNA, 1611 nt, Artificial Sequence
  derived and/or modified sequence opt3 from capsid_protein__Norovirus__ACX81345
augaagauggccagcaacgacgcuacccccuccgaugacggcgcagccgggcuggugccugagaucaauucugaagucauggcgcucgagccaguugcuggagccucacuugcagccccggugguaggucagcaaaacauuauagaucccuggaucagaaauaacuucgugcaggcuccugcaggcgaauuuacagucaguccaaggaauagccccggggagcuguuguuagaccuggaacuaggaccugagcucaacccauaccuggcccaccuugcucggauguauaauggccaugccggugggauggaggugcagauuguucuggcgggaaacgcauucacugccggcaaaaucuuguuugcugccauucccccuuccuucccauacgaaaaucucucuccggcacagcugacgaugucgccccacgugaucgucgaugugcgccaacugaagccuguacucuuaccaaugcccgacaucaaaaacgauuuuaaucauuauaaccagaagaauaacaccaaacugcgacuuguugcuauguuguacacaccucugcgugccaauaacucaggcgacgaugugugcacugagagcuguagaguccuaaccaggccaagucccgacuuccaguuuacauuccucgugccgccuaccguggaauccaagacuaagaacuuuacacugcccguccuucggguuucugagaugaccaauagccgcuucccagugguacuggaucagauguauacguccagaaacgagaauauaauugugcaaccucagaacgggaggugcacuaccgacggagaauugcucgguacaacuauccugcagucagucaguauuuguaauuuuaaaggcaccaugcaggcgaaguuaaacgaggaaccccgguaccaacugcagcucacaaaucuugaugggagcccaaucgaccccaccgacgauaugccugccccacugggaacgccggacuuccaggcaauguuguauggcguggcuucucaacgcuccucaauagauaacgccacucgagcucacgacgcccagauugauacagccggugacaccuuugcacccaaaaucgggcagguuagauucaagagcaguucuaaugauuucgaccuacaugauccuacuaaauuuacaccaauuggagugaacgucgacgaucagcaccccuucaggcaauggucccugccuaauuacggcggccaccucgcucugaacaaucaucuugcgccagcagugacgccccuguuuccgggggagcagaucuuguucuuucggagcuacaucccuucggccggaggucacaccgacggcgcuauggacugccuccugccacaggaauggguagagcauuucuaucaggaggccgcacccucucaauccgauauugccuuaguucguuuuauaaacccugacaccgggcgcgugcuguucgaagcuaagcuacacaagcagggauuucucacaaucgccgcaucaggcgaucaccccauugucaugccaacuaaugguuacuucagauuugaggcgugggugaacccuuucuauacccuggcucccgucgggacaggcaguggaaggcggcgaauccaguga

SEQ ID NO: 19344 - RNA, 1611 nt, Artificial Sequence; identical to SEQ ID NO: 19341
  derived and/or modified sequence opt3 from capsid_protein__Norovirus__ACX81347

SEQ ID NO: 19345 - RNA, 1611 nt, Artificial Sequence; identical to SEQ ID NO: 19341
  derived and/or modified sequence opt3 from capsid_protein__Norovirus__ACX81349

SEQ ID NO: 19346 - RNA, 1611 nt, Artificial Sequence; identical to SEQ ID NO: 19341
  derived and/or modified sequence opt3 from capsid_protein__Norovirus__ACX81351

SEQ ID NO: 19347 - RNA, 1611 nt, Artificial Sequence
  derived and/or modified sequence opt3 from capsid_protein__Norovirus__ACX81353
augaagauggccagcaacgacgcuacccccuccgaugacggcgcagccgggcuggugccugagaucaauaacgaagucauggcgcucgagccaguugcuggagccucuauugcagccccggugguaggucagcaaaauauaaucgaucccuggauuagaaacaauuucgugcaggcuccugcaggcgaauuuacagucucaccaaggaacagucccggggagcuucuguuggacuuagaacugggaccugagcuaaauccauaccucgcccaccuggcucggauguauaacggccaugccggugggauggaggugcagaucguucuugcgggaaaugcauucacugccggcaaaauucuguuugcugccauacccccuagcuucccauacgaaaacuuguccccggcacagcucacgaugugcccccacgugaucgucgaugugcgccaacuggagccuguacugcucccaaugcccgacauccgaaauguguuuuaucauuacaaccagaauaacucuccuaaguuacgucugguugcuaugcuuuauaccccauugagagccaauaacucgggcgaugacgucuucacagugucauguagggugcugacucggcccagcccggauuuucaguucaccuuucuagucccucccacaguugaaaguaaaaccaagaacuucacucucccagugcugcgcguauccgagaugacaaauucuagauuuccugugguccuugaccagauguacaccagcaggaacgagaauauuaucgugcaaccccagaacgggcggugcacgacugauggagaacuguuggguaccacaauucuccaguccguuucaaucuguaauuucaaaggcacuaugcaggcgaagcugaacgaggaaccacgcuaucaauuacagcugaccaaucucgacgggagucccauagauccuacagacgacaugccagccccgcuuggaacccccgauuuucaggcaaugcuguacggcguggcuagccaacgaucuuccagagacaacgccacgagggcucacgaugcccagauugacacugccggugauacauucgcaccuaagaucgggcagguccgguucaaaucaagcaguaaugacuuugauuugcaugacccaaccaaguucacucccauuggagugaacguagaugaccagcacccuuuucgucaauggucucuaccaaauuacggcggccaccuggcucucaacaaucaucuggcgcccgcaguuacaccgcuuuucccuggggagcagauccuguuuuuccgcuccuauaucccaagcgccggaggucacaccgauggcgcuauggacugcuugcucccccaggaauggguggagcauuuuuaccaggaggccgcaccuucgcaaucugacauugcccuggucagauucauaaaccccgauacggggaggguguuauuugaagcuaaacugcacaagcagggauuccuaaccaucgccgcauccggcgaccacccaauugucaugccuacaaaugguuauuuucgguucgaggcgugggugaaccccuuuuacacucucgcuccaguugggaccggcucaggacgacgcagaauccaguga

SEQ ID NO: 19348 - RNA, 1611 nt, Artificial Sequence; identical to SEQ ID NO: 19341
  derived and/or modified sequence opt3 from capsid_protein__Norovirus__ACX81355

SEQ ID NO: 19349 - RNA, 1623 nt, Artificial Sequence
  derived and/or modified sequence opt3 from capsid_protein__Norovirus__ACX85806
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauucuuacgccggcgguuucgaagugcaggucauucuagcggggaacgcauuuacugccggaaaaaucauuuucgcugccgugccuccaaauuuuccgacggagggccucucgcccucacagguaaccauguucccucauaucguuguggacguccgccaacuggagccagugcuuauaccccugccugaugugcgaaacaauuuuuaucacuacaaccagagcaaugacccaacaaucaaguugauugcaaugcucuauacuccccugcgugcuaacaacgccggcgaugacgucuucaccguuaguugcagagugcugacaaggccguccccugauuuugacuucaucuuucucguacccccaaccguggaaucucggacuaaaccuuucagcguccccauuuuaacaguggaggaaaugaccaauucccgcuuuccaaucccccuggagaaacuuuucacggggccuucaagugcguucguugugcagccacagaacggaagauguacuaccgauggugucuugcugggcacaacucaacuaagcccggugaauauaugcaccuuuagggggaacguaacacauauugccggaacccaggaguacacgaugaaucucgcaucucagaacuggaauaacuaugaccccacugaagagaucccugcuccacugggcacacccgauuucguugguaagauucagggggugcuuacccaaacuacacggcgcgacggauccacccgaggccacaaggccacggucucaaccggcagcgugcauuuuacaccuaagcuggggagaauccaguucaguacugacaccucuaaugauuuugaaacaggacagaacacuagguucaccccagucggugugguucaagacggcuccacaacccaccagaaugagccccagcaguggguguugccgaacuacagcgggcgggauucgcacaauguacaucucgcuccugccgucgcaccaucuuuucccggagaacaacuguuauucuuucguuccacuaugccuggcuguucagguuaccccaacaugaaucuggacugccuccuuccacaggagugggugcagcacuucuaucaggaggccgcuccugcgcaaagugauguugcacuguugcgcuuugugaaccccgacacggggagaguccuauucgaauguaaacugcauaagagcggcuacgugacaguagcccacaccggacagcacgaucucgugaucccaccgaacggcuauuuuagguucgacuccuggguuaaucaguucuacacucuggcuccuauggggaacggaaccggucggcgacgcgcccuuuga

SEQ ID NO: 19350 - RNA, 1647 nt, Artificial Sequence
  derived and/or modified sequence opt3 from capsid_protein__Norovirus__ACX85807
augaagauggccagcaacgacgcugcacccuccaaugauggcgccgcggggcuggugccugagaucaacucugaagcuauggcccucgagccagucgcaggagccgcuauugcagccccgcuuaccggucagcaaaauauaaucgaccccuggauuaugaacaauuucguucaggcuccuggcggggaauuuacagugucaccaagaaacagucccggagagguacuguugaauuuagaacugggcccugagaucaacccauaccuagcccaccucgcgaggauguauaaugguuacgcagggggauucgaggugcaggucgugcuggccggcaacgcucuuacugccggcaaaauuaucuuugcagcuauacccccuaauuucccaaucgauaaccugagcgccgcgcagauuacgaugugcccgcauguuaucguggacguccggcaauuggaacccgugaaucucccuaugccagauguacgcaacaacuuuuuccacuauaaucagggguccgacucucgacugcgucugauugccaugcucuacacccccuuaagagcaaacaauucgggagaugacguuuuuacagugucauguaggguccugacucggccuagcccagauuucaguuuuaacuuccuugugcccccgaccguggaguccaagacaaaaccuuuuucuuugcccauccugaccauaagcgaaauguccaauucacgcuucccagucccuauugacagucuacauacuagccccacagagaacaucguugugcagugccagaaugguagaguaacccucgauggcgagcugauggggacgacucaacuucugccaucucagauuugugcuuuuaggggaguguugacccgguccacaucacgcgccagcgaccaggcugauacugccacaccccgacucuucaacuauuacuggcacauccagcuggacaauuuaaacggcaccccuuaugacccagcagaagauaucccggguccccuggggaccccugacuucagaggaaaggucuuuggcguggccagucaaaggaauccagaugcuacgacucgggcgcaugaggcaaaaauugacacaaccucuggccguuucacucccaagcucgggucccuugaaauaagcacagagucggaugacuuugaucagaacaagccuacccgcuucacgccaguuggaaucgguguggaccacgaagaggauuuucagcaauggacccugcccgacuacgccggccaguucacacacaauaugaacuuggcuccggccgucgcaccuaauuuuccaggggagcagcuacuguucuuuagaucucagcuccccuccucaggaggcaggaguaacgguauucuggauugccuugugccucaagaauggguacagcauuucuaccaggagagcgcccccucccagacucaaguugcucuggugcgguauaucaauccagacaccgggcgagucuuguuugaagccaaacuccacaagcugggcuucaugacaauagcgaaaaacggagacucuccuauuacugugcccccaaacggcuacuuucgcuucgagagcugggucaauccguucuauaccuuagcaccuauggggacaggaaacgguagaaggcggauccaguga

SEQ ID NO: 19351 - RNA, 1623 nt, Artificial Sequence
  derived and/or modified sequence opt3 from capsid_protein__Norovirus__ACX85809
augaagauggccagcaacgacgcugcacccuccaaugauggcgccgcggggcuggugccugaaauuaacaaugaagucaugccacucgagccgguugcuggagccucucuugcaacccccgugguaggucagcaaaacauuauagacccuuggaucagaaauaacuucgugcaggccccagcuggcgaauuuacagucucacccaggaauaguccuggggagauucuguuggauuuagaacugggaccagagcuaaaccccuaccucgcacaccuggcccggauguauaauggccaugcuggugggauggaggugcagaucguucuugccggaaacgcguucacugcaggcaaaauuaucuuugccgcuauaccuccaggcuucccguacgaaaaucugagccccucccagaucacgaugugcccucacgugauuaucgacguccgccaauuggagccagugcuccugcccaugccugauauucgaaacaacuuuuuccauuauaaucaggggaaugacccaaagcugcgucucaucgccauguuauacacaccccugagagcaaacaacucuggagaugacguauuuaccguuucguggaggggucuuacuaaaaccucaccggauuucgaauuuacauucuuggugccucccaccgucgagagcaagacuaaacaguuuacacugccaauacuaaagauuagugagaugaccaauucccgguucccugugcccguggaaaugauguauacggcucgcaacgagaaucaggucguucaaccacagaacggcagagugacucucgacggggaacugcuuggaaccacaccccuguuggccguaaauaucuguaaguuuaaaggcgaggugauugcgaagaacggugaugucaggucuuaccggauggacauggaaaucacuaauaccgaugggacaccuaucgacccaaccgaggacacgccgggacccauuggcagcccugauuuccagggcauacucuucgggguggccucccagcgcaacaaaaaugagcaaaacccagcaacucgagcucacgaagccaauaucaacacaggaggugaccaguaugcucccaagcuggcccagguuaaauuuuucucagagagucaagauuuugaagugcaucagccuaccgucuucacuccagugggcguagcaggggacacaagccaccccuuuagacaguggguuuuaccgagguacggaggccaccugaccaauaacacgcaucucgccccugcuguggcgccacuuuuccccggugagcagauucuguuuuuccggucucaaaucccuuccucagggggccacgaauugggauacauggauugccuagucccccaggagugggugcagcauuuuuaucaggaggcagccaccgcucaaagcgaagucgcccugauacguuucauuaauccagacacaggccgcgugcucuuugaggcaaagcugcacaagcagggguucaucacuguugcccacaccggagauaacccuaucgugaugcccccaaacgguuacuuuagauucgaggcuuggguaaaucaguucuauagucuugccccggucggcacagggaacggaaggcggcgaauccaguga

SEQ ID NO: 19352 - RNA, 1623 nt, Artificial Sequence
  derived and/or modified sequence opt3 from capsid_protein__Norovirus__ACX85810
augaagauggccagcaacgacgcugcacccuccaaugauggcgccgcggggcuggugccugagauuaacaaugaagucaugccacucgagccgguugcuggagccucucuugcaacccccgugguaggucagcaaaacauuauagacccuuggaucagaaauaacuucgugcaggccccagcuggcgaauuuacagucucacccaggaauaguccuggggagauucuguuggauuuagaacugggaccagagcuaaaccccuaccucgcacaccuggcccggauguauaauggccaugcuggugggauggaggugcagaucguucuugccggaaacgcguucacugcaggcaaaauuaucuuugccgcuauaccuccaggcuucccguacgaaaaucugagccccucccagaucacgaugugcccucacgugauuaucgacguccgccaauuggagccagugcuccugcccaugccugauauucgaaacaacuuuuuccauuauaaucaggggaaugacccaaagcugcgucucaucgccauguuauacacaccccugagagcaaacaacucuggagaugacguauuuaccguuucguguagggugcuuacuaaaccgucaccugauuucgaauuuaccuucuuggugcccccaacagucgagagcaagaccaaacaguuuacucugccuauacuaaagauuagugagaugacaaauucccgguuccccgugccagucgaaaugauguauaccgcucgcaacgagaaucagguugugcaaccccagaacgguagaguaacgcucgacggcgaacugcuugggacuaccccucuguuggccgugaauaucugcaaguuuaaaggagaggucauugcgaagaacggcgaugugaggucuuaccggauggacauggaaaucacaaauacugaugguaccccaaucgacccgacagaggacacccccgggccuauuggaagcccagauuuccagggcauacucuucggcguugccucccagcgcaacaaaaaugagcaaaaccccgcaacgcgagcucacgaagccaauaucaacacugggggagaccaguaugcuccuaagcuggcccaggugaaauuuuucucagagagucaagauuuugaaguccaucagccaacaguguucacccccguagguguugcaggcgacacuagccacccguuuagacaguggguguuaccuagguacgggggacaccugacaaauaacacccaucucgccccagcugucgcgccccuuuucccuggcgagcagauucuguuuuuccggucucaaauccccuccucaggugggcacgaauugggcuacauggauugucuagugccacaggaguggguccagcauuuuuaucaggaggcagccgcugcccaaagcgaaguggcacugauacguuucauuaauccugacacgggacgcguucucuuugaggccaagcugcacaagcagggcuucaucaccguggcucacacaggggauaaccccaucguaaugccaccgaacggauacuuuagauucgaagccugggucaaucaguucuauagucuugcaccuguggguacuggcaacgggaggcggcgaauccaguga

SEQ ID NO: 19353 - RNA, 1569 nt, Artificial Sequence
  derived and/or modified sequence opt3 from capsid_protein__Norovirus__ACY41155
augaagaugaccgacagagauacaacugaccccgccccugcucugggccaggugcucccaccggaggucgaagcaagcguucccguggagccuacggccggggcgccaguagcugccgcaaccgccggacaagugaaccccaucgauccuuggauuuucgcuaauuuuguccaggcaccacagggugaguucacaauaucccccaacaauaacccuggcgagauccuuuuugaacuggaguuggggccagaguuaaauccguaccuggcccaccuaaggcggauguauaacggauggacuggcucuaugcgcgugcgaguucuccuggcugguaaugccuucucagcggggaaaguggucguguuuugcguacccccuggauucgacgcaaguuaccuuaccccaagccaggccacacaauuuccccauguucugauugaugugcgugcuccugaaccagucgagaugcccuuggaagacgugagaaacauccucuuccaccagggcccggauuccaggaugcggcugaugggcaugcuguauaccccucuccgcgccaauucuggggcagaccccuuuguggucacuggaagaguuuuaacauguccaucgccuaacuucucauuuuucuuucuggugcccccaaccguagaggagagggaagugcccuucacgcuuccuaauuugccagucaacaaucugagccauagucgggugauggagccgauugcucagaugauguccucucgcaaccuacccgccagcguucaguuccaaaauggucgaugcacucucgcgggcgaucugcuugggaccacaccuuccucaccagccgaccugggaacuuuugugggcuugaucgcagaacccgguaguagagucguggaacucuuccagccuaaccaggaagauuuucacgcugggagcgccccagcuccccugggauucccggacuuuucugauuguuccuuaaccuucguaguugccucaagcacaaccgugggcgagaggacggucaacagucggucuccucagaauuuuacuccagcacugggccaugugacacucgacgaggaagcccccgcugaccuuuuccgugcgcgccugagaaacuugugggauccuaccgagcacuccuuuuggaggauacccgacuaccgggcagauguccuagggagcgaguucgccccaucggugucugcuccuggaguuggugaaacucugcucuuuuucaugugcaaugugccccgacugaacggcgccaauccaaacccguguccuugccuucugccccaagaauggaucacacacuuuguauccgagcgcgcagccuugcagggggacgucgcucuccugaauuaugugaacccaaauaccggaagaguuuuauucgaguguaagcuguacgccaacggcuuccuaacggugaaucucggugcaucagaucaggcgacccugcccgucgacgggauuuuuaaauucgugaguugggugagcuuuuauuaccaacuuaggccuguaggcaacgcuuccguuggacggcgcuugccaagacugaauggcuucuga

SEQ ID NO: 19354 - RNA, 1623 nt, Artificial Sequence; identical to SEQ ID NO: 18688
  derived and/or modified sequence opt3 from capsid_protein__Norovirus__ADA77528

SEQ ID NO: 19355 - RNA, 1620 nt, Artificial Sequence
  derived and/or modified sequence opt3 from capsid_protein__Norovirus__ADB22512
augaagauggccagcaacgacgcugcacccuccaaugauggcgccaccgggcuggugccugaggucaacacagaaacucucccacuugagccgguugcgggagcugccaucgcagcccccgugacgggucagaauaacauuauagacccuuggaucagaucuaauuucguacaagcuccaaacggcgaauuuaccgugucacccaggaauaguccuggggagauucugaugaacuuggaauuaggaccagaucugaaucccuaccuagcacaccucagccggauguauaacggcuacgccgguggggucgaggugcagguucugcuugcuggaaaugccuucacagcgggcaaaauccuguuugcagccgugccuccaaacuucccggucgacauguugucccccgcucagauuacuaugcucccucaucugaucguggauguacgcacccuggagccaauaaugaucccccucccugacguucgaaauguguuuuaucacuucaacaaucagccagcaccccguaugagauuagucgccaugcuguacacaccgcuuaggucuaacggcucgggggaugacguguuuaccgugucaugccgggucuugacucgcccuacacccgauuucgaauuuaccuaucugguuccaccuagcguggagaguaagacgaaacccuucacucuaccaauucucaccaucggagaacugacaaacuccagauuucccgcuccuauugaccaacuuuacacuucuccaaaugccgauguagugguccagccgcagaacgguagguguacccuggacggcgaguugcaggggacaacccaacuccugacgacugcgaucugcagcuaucggggaaugacauccaaucccaccucagauuacugggacggccauuuacugcaccucgugcauccuaacggugccacuuacgacccaacagaggauguucccgcaccuuucgggacccaggacuuucgcggaauacuuuauggcaugcugacgcagaauccacgaaccaguggcgaugaagcugccaacagccacgggguguacauuucuuccacaucagagaaguucacucccaaauugggaaccaucggucuacaccagguccaaggcgaccauagccagcagcaacagaguaaguucacaccgguggggauugcuguaaauggaaacacuccuuuuagacagugggaacugccaaauuauucuggcgcccucacccugaacacaaaucuugcacccgccguugguccuaacuuccccggggagcagauccuguuuuucagguccaaugugccaagcguccaaggcggacagccuaucgaaauugauuguuugauaccccaggagugggugucgcacuuuuaccaggagucugcuccaucccaaucagacgucgcgcucgugcgguauguuaacccggauaccggccguacuaucuucgaagcaaagcugcaucgccagggguuuauuacgaucgccgcuacaggaaguaauccugugguagugcccccaaacgguuacuucagauuugacagcugggucaaccaguucuaugccuuagcacccaugggcaccgggaauggaaggcggcgaauacaguga

SEQ ID NO: 19356 - RNA, 1623 nt, Artificial Sequence
  derived and/or modified sequence opt3 from capsid_protein__Norovirus__ADC91993
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgucagacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggggaaccacacaccgaaaugaaccccagcaaugggugcucccgucuuacuccggcagaaacguucagaaugugcaccuggccccugcaguagcuccaaccuuucccggugagcaguuacuguucuuuaggagcacuaugccuggguguucgggcuaucccaacauggaucucgacugccuucugccacaggaguggguccaacauuucuaccaggaagcggccccugcacagucugauguggcuuugcuacgguuuguuaaucccgacacgggacgugugcuguucgaguguaaacuccacaaguccggcuaugucacaguggcccauaccgggcagcacgaucugguaauuccaccgaacggauacuuucgcuucgacucaugggugaaccaauucuauacucuugcaccuauggguaauggcaccgggagaaggcgggcccuguga

SEQ ID NO: 19357 - RNA, 1623 nt, Artificial Sequence
  derived and/or modified sequence opt3 from capsid_protein__Norovirus__ADC91994
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucacgggcagucggaacuacacuaugaaucucgccacacagaacuggaauagcuaugaucccaccgaggaaauuccugcaccacuggguacucccgacuucguagggaagauccagggaguucuuacacagaccacgcgcgcugacggcucuacccgaggccacaaggccacaguguacacuggguccgcugauuuuucaccuaagcugggaagaguccaauucgccaccgacacagauaacgacuuugaugcaaaucagaacacuaaauucaccccagugggugucauccaggacggcgauacagcccauaggaaugagccccaacaguggguguugccgagcuacagugggcggaacucucacaauguucaccucgcuccugcgguggcaccaaccuuucccggagaacagcuguuauucuuucguuccacuaugccuggcuguagcgguuaucccaacauggaccuggauugccuccuuccacaggaguggguacaauacuucuaucaggaagccgcuccugcccagucggacgucgcacuguugcgcuuugugaaucccgauacggggagaguucuauucgaguguaagcugcauaaaucuggcuacgugacagucgcccacaccggacagcaugaccucgugauuccaccgaacggcuauuuuagguucgacuccuggguaaaccaauucuacacucuggcuccuauggggaauggaaccggucggcgacgcgcccuuuga

SEQ ID NO: 19358 - RNA, 1611 nt, Artificial Sequence; identical to SEQ ID NO: 19341
  derived and/or modified sequence opt3 from capsid_protein__Norovirus__ADE28701

SEQ ID NO: 19359 - RNA, 1644 nt, Artificial Sequence
  derived and/or modified sequence opt3 from capsid_protein__Norovirus__ADE28721
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaggaugucuuuacaguuucaugucgcguguuaacuagaccagcccccgacuucgaguuuaccuuccugguaccgccuacaguggaaagcaagaccaaacccuuuacucuuccaauuuugacacugggcgagcuaaguaacuccagguucccugcgcccaucgauaugcucuauccagaccccaaugaagggauugucgugcaaccucagaacggacggugcacccuggaugguacgcuucagggcacuacccagcugguuccaacacaaaucugugccuuucgcgggacuuugauaggacagaccucucgaagcuccgacucaacagauagugcaccgagaaggcgggaccacccccuccaugugcagcugaagaauuuagauggcacccaauacgacccuacggacgaggucccagcugugcugggugccauugauuucaaagggacuguauucggaguugcuagccagcgugacgugucuggccagcaggucggcgccacacgcgcacacgaagugcacaucaacaccacugaucccagauauacaccuaagcucggguccauucuuaugcauucagagagcgacgauuuugucaccggacaaccagugagguucacgcccaucgguaugggcgacaaugauuggcaccagugggagcugccggacuacagugggcauuugacccuaaacaugucucuggccccugcuguugcgccagcauuucccggagaacggauccucuucuuucgauccauugugccuagcgccggcgguuacgggucgggcuauauagauugccugaucccccaggaguggguacagcacuucuaccaagaagcugccccaucucaguccgcagucgcccuuauucgcuaugugaauccugacacaggaagaaacaucuuugaggcuaagcugcacagggaaggcuucauaacuguugccaauucagggaacaaucccauuguggucccaccgaacggauacuuucgguucgaggcaugggugaaucaguuuuauaccuugacaccuauggguacuggccaggggcgcagaaggaaccaauga

SEQ ID NO: 19360 - RNA, 1644 nt, Artificial Sequence
  derived and/or modified sequence opt3 from capsid_protein__Norovirus__ADE28722
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaagauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaggaugucuuuacaguuucaugucgcguguuaacuagaccagcccccgacuucgaguuuaccuuccugguaccgccuacaguggaaagcaagaccaaacccuuuacucuuccaauuuugacacugggcgagcuaaguaacuccagguucccugcgcccaucgauauguuuuauaccgacccaaaugaagggauugucgugcacccccaaaacggacggugcacgcucgaugguacucugcagggcaccacacagcuuguuccuacucagaucugugccuuccgcgggacccugauaggacaaacaucucgaagcuccgacucaaccgauagugcaccaagaaggcgggaccauccguugcacgugcagcucaagaaucuggauggcacgcaguacgaccccacugacgaggucccugcuguguuaggugccauugauuucaaagggacaguauuuggaguugcuagccaacgugacgugucuggccagcaggucggcgccacccgcgcacacgaagugcauaucaacacuacagauccaagauauacccccaagcugggguccauucucaugcacucagagagcgacgauuucgucacgggacagccugugagguuuaccccaaucgguaugggcgacaaugauuggcaucaaugggagcuucccgacuacagugggcaccugacauugaacaugaaucuagccccggcuguugcgccugcauucccaggagaacggauccuguuuuuccgaucuauugugcccuccgccggcgguuacgggagcggcuauauagauugccucaucccucaggaguggguacagcacuuuuaccaggaagcugcccccucgcaaucugcagucgcccugauucgcuaugugaacccagacacuggaagaaauaucuucgaggcuaaacuucauagggaaggcuuuauaaccguugccaacuccgggaauaacccuauuguggugcccccaaauggauacuuccgguuugaggcaugggucaaccaguucuauacacugacuccgauggguaccggccaggggcgcagaaggaaucaguga

SEQ ID NO: 19361 - RNA, 1644 nt, Artificial Sequence
  derived and/or modified sequence opt3 from capsid_protein__Norovirus__ADE28723
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaggaugucuuuacaguuucaugucgcguguuaacuagaccagcccccgacuucgaguuuaccuuccugguaccgccuacaguggaaagcaagaccaaacccuuuacucuuccaauuuugacacugggcgagcuaaguaacuccagguucccugcgcccaucgauaugcucuauaccgacccaaaugaagggauugucgugcaaccccagaacggacggugcacgcuggaugguacucuucagggcaccacacagcugguuccuacucaaaucugugccuuucgcgggaccuugauaggacagauuucucgaagcuccgacucaacagauagugcaccaagaaggcgggaccacccgcuccaugugcagcugaagaauuuagauggcacccaauacgaccccacggacgaggucccugcugugcugggugccaucgauuucaaagggacuguauucggaguugcuagccagcgugacgugucuggccagcaggucggcgccacacgcgcacacgaagugcacauuaacaccacugauccaagauauacacccaagcucggguccauccuuaugcauucagagagcgacgauuuugucaccggacaaccugugagguucacgccaaucgguaugggcgacaaugauuggcaccagugggagcugcccgacuacagugggcauuugacccuaaacaugaaucuggccccggcuguugcgccugcauuuccaggagaacggauucucuucuuucgaucuauagugcccuccgccggcgguuacgggagcggcuauaucgauugccugauuccucaggaguggguacagcacuucuaccaagaagcugcccccucgcagucugcagucgcccuuauccgcuaugugaacccagacacaggaagaaauauauuugaggcuaagcugcacagggaaggcuucauuacuguugccaacuccgggaauaacccuaucguggugcccccaaauggauacuuucgguucgaggcaugggucaaccaguuuuauaccuugacaccgauggguacuggccaggggcgcagaaggaaucaauga

SEQ ID NO: 19362 - RNA, 1644 nt, Artificial Sequence
  derived and/or modified sequence opt3 from capsid_protein__Norovirus__ADE28724
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaaaauacgccccguaugaggcugguggcaaugcuguacaccccucuccgggcuaacucgggcgaggaugucuuuacaguuucaugucgcguguuaacuagaccagcccccgacuucgaguuuaccuuccugguaccgccuacaguggaaagcaagaccaaacccuuuacucuuccaauuuugacacugggcgagcuaaguaacuccagguucccugcgcccaucgauaugcucuauaccgacccaaaugaagggauugucgugcaaccccagaacggacggugcacgcuggaugguacucuucagggcaccacacagcugguuccuacucaaaucugugccuuucgcgggaccuugauaggacagacaucucgaagcuccgacucaaccgauagugcaccaagaaggcgggaccacccgcuccaugugcagcugaagaauuuagauggcacgcaauacgaccccacugacgaggucccugcugugcugggugccauugauuucaaagggacaguauucggaguugcuagccagcgugacgugucuggccagcaggucggcgccacccgcgcacacgaagugcacaucaacacuacagauccaagauauacccccaagcucggguccauucuuaugcauucagagagcgacgauuuugucacgggacaaccugugagguucaccccaaucgguaugggcgacaaugauuggcaccagugggagcugcccgacuacagugggcauuugacacuaaacaugaaucuggccccggcuguugcgccugcauuuccaggagaacggauccucuucuuucgaucuauugugcccuccgccggcgguuacgggagcgauuauauagacugccugaucccucaggaguggguacagcacuucuaccaagaagcugcccccucgcagucugcagucgcccuuauucgcuaugugaacccagauacuggcagaaauaucuuugaggcuaagcugcacagggaaggauucauaaccguugccaacuccggcaauaacccuauuguggugcccccaaauggguacuuucgguucgaggcaugggucaaccaguuuuauacauuggcgccgaugggaacuggucagggccgcagaaggaaucaauga

SEQ ID NO: 19363 - RNA, 1647 nt, Artificial Sequence
  derived and/or modified sequence opt3 from capsid_protein__Norovirus__ADK23787
augaagauggccagcaacgacgcuacccccuccaaugauggcgcagccgggcuggugccugagaucucuaacgaagcgauggcucucgacccagucgccggagcagccauugcugcaccgcuuacaggucagcaaaauauaaucgaucccuggauuaugaacaauuucguucaggccccuggcggggaguuuacugugucaccaagaaacagucccggagaaguacuguugaauuuagagcugggcccugaaaucaacccauaccuagcucaccucgccaggauguauaaugguuacgcagggggauucgaggugcaggucgugcuggcgggcaacgccuuuacggcuggcaaaauuaucuucgccgcaauacccccuaauuuuccaaucgacaaccuuagcgcugcccagauuaccaugugcccgcauguuaucguggauguccggcaacuggagcccgugaauuugccuaugccagacguacgcaacaauuucuuucacuauaaccagggguccgauucucgacuccgucugguugcgaugcuguacacaccccucagagccaacaauucgggagacgauguguucacugucucauguaggguguuaacccggccuagcccagacuuuaguuucaacuuucuggugcccccgacagucgaauccaagaccaaaccuuucacucuucccauuuugacaaucucugagaugagcaauucccgcuuuccaguuccuauagauucacugcauaccagucccacggaaaacgugguagugcagugccagaaugguagagucacucuagacggcgagcucauggggaccacacaacugcuuccaagccagauuugugcauucaggggagugcugacucggucuaccucccgcgcuucagaucaggccgacacagcuacgccccgauuguucaacuauuacuggcacauccagcucgacaaucugaacggcaccccuuaugauccagccgaggacauuccgggucccuuagggacuccugauuuuagaggaaagguuuucggcguggcaagccaaaggaauccagacaguacaacccgggcccaugaagcuaaaaucgauacuacagcgggccguuuuacccccaagcuggggucucucgagaucuccacggaaagcggagacuucgaucagaaccagccuacccgcuuuacaccagucgguauuggcguggaccacgaggcagauuuccaacaguggucgcuucccgacuacucugggcaguuuacucacaauaugaaccuggccccggcuguagccccuaauuucccaggagaacaguugcuauuuuucagaucccaacugcccucaaguggcgguaggagcaacgggauacucgauugccugguuccucaggagugggugcagcauuuuuaccaggaguccgcacccgcccaaacccaggucgcucuugugcgguaugucaauccagacacaggccgagugcuguucgaagccaaguugcacaaacucggauuuaugacuaucgcaaagaacggcgacucuccuauuaccguucccccaaacggguacuuccgcuucgagagcugggugaauccguuuuauacacuggcgccuaugggaaccgguaacggcagaaggcggauccaguga

SEQ ID NO: 19364 - RNA, 1623 nt, Artificial Sequence
  derived and/or modified sequence opt3 from capsid_protein__Norovirus__ADM52743
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaugacguguucaccgucucaugcagaguucugacaaggccgagcccugauuuugacuucauuuuucucgugcccccaaccguagaaagucggacuaaaccuuucuccgugcccaucuuaacagucgaggaaaugaccaacucucgcuuuccaauaccccuggagaaacuuuucacgggaccuagcuccgcguucgugguucagccacagaaugguagauguacuaccgauggcguguugcuggggacaacucaacuaucaccggucaacauuugcaccuuuaggggagacgugacacauaucaccggcagucggaauuacacgaugaaccucgccacucagaauuggaacagcuaugaucccacagaggaaauuccugcaccacuggguacccccgacuucguagggaagauccagggaguucuuacucagacaacccgcgcugacggcucuacgcgaggccacaaggccaccguguacacaggguccgcugauuuugccccuaagcugggaagaguccaauucgcaacugacaccgauaaugacuuugaugccaaccagaauacaaaauucacuccagugggugucauccaggacggcaacaccgcucauaggaaugagccccaacaguggguguugccgucauacagcgggcggaacagucacaauguucaccucgcgccugcaguggccccaacauuucccggagaacagcuguuauucuuucguucuaccaugccuggcuguuccgguuaucccaacauggaucuggacugccuccuuccacaggaguggguacaauacuucuaucaggaagcugccccugcacagagcgaugucgcccuguugcgcuuugugaaccccgacacugggagaguucuauucgaguguaagcugcauaaaucgggcuacgugacggucgcucacacaggacagcaugaucucgugauuccaccgaauggcuauuuuagguucgacucuuggguaaaccaauucuacacccuggccccuauggggaauggaacuggucggcgacgcgcacuuuga

SEQ ID NO: 19365 - RNA, 1623 nt, Artificial Sequence
  derived and/or modified sequence opt3 from capsid_protein__Norovirus__ADR57234
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccaguugaaugacccaacaauuaagcucaucgcaaugcuguauacuccccugcgugcuaacaacgccggggaugacguguucaccgucucaugcagaguucucacaaggccgagcccugauuuugacuucaucuuuuuagugcccccaaccguagaaagucggacuaaaccuuucuccgugcccauucugacagucgaggaaaugaccaauucucgcuuuccaauaccccuugagaaguuguucacgggaccuagcuccgcguucgugguucagccacagaacgguagauguacuaccgauggcgugcugcuagggacaacucaacucucaccggucaauauuugcaccuuuaggggagacgugacacauaucaccggcagucacaacuacacgaugaaucuggccagccagaacuggaacucuuaugaucccacugaggaaauuccugcaccacuugguacacccgacuucguagggaaaauccagggaguucugacccagacuacacgggcugacggcuccacccgcggccaucgagccacgguguacaccgggucagcugaguuugccccuaaguugggaagaguccaauucgcaacagauacugaaaaugacuuugauaccaaucagaacacaaaguucacuccagugggugucauccaggacggcaauaccacacacaggaacgagccccaacagugggugcucccgagcuacagugggcguaauucucacaacguucaucuggccccugcuguggcgccaaccuuucccggagaacaguuacuguucuuucgguccacuaugccuggcuguagcgguuaucccaaucucgaucuugacugccuguugccacaggaguggguacaacacuucuaccaggaggcagccccugcucagucggaugucgcccuacugcgcuuugugaaccccgacacggggagaguucucuucgaauguaaacugcauaagucuggcuaugugacagucgcacacaccggacagcacgaucuugugauuccaccgaacggcuacuuuagguucgacuccuggguaaaucaauucuauacucuggccccuauggggaacggaaccggucggcgacgcgcuuuguga

SEQ ID NO: 19366 - RNA, 1626 nt, Artificial Sequence
  derived and/or modified sequence opt3 from capsid_protein__Norovirus__AEA07712
augagaaugagcgacggcgccgcucccaaggcauccgggucugaggccucaggacaggaucuggugccuagugcggucgaacaagcuguuccaauccagccggugguaggugccacccucgcagcccccgcugcaggccagauuaaccagauagacccuuggaucuuccaaaauuuugugcagugcccacuuggggaguucagcauuucccccaggaacacaccuggagaaauccuguuugauuuggccuuaggcccaggucugaaucccuaccuagcucaccucucugccauguauacugggugggucggaaacauggaggugcagcugguucuugcgggcaaugcauucacggccggcaaaguggucguggcucugguaccuccauacuuuccgaaggggucgauuaccacagcccagaucacuuguuucccccauguuaugugcgacgugcggaccuuggaaccuauacaacucccacugcuggauguccgccgagugcucuggcacgcaacacaggaccaggaggagucaaugcguuuaguguguaugcuguauacuccccuuagaaccaacagcccuggagaugaaaguuuugucguuuccgguagguugcugucuaaaccagcugccgacuucaauuuuguguaccuaacacccccgaucgagcggaccauuuaucgcaugguagaucucccugugcugcagcccagacuuugcacgcaugcgagguggccagccccugucuacggccuguugguggaccccagccucccauccaacccccaauggcagaaugggcggguucacguggauggaacucuguuaggcaccacaccugucucagguaguugggugagcuguuucgcagcugaagccgcuuaugaguuucagucugggaucggagagguagccacuuucacccugauugaacaagacggcuccgcauaccucccaggcgaucgcgccgcuccgcuuggguaccccgacuuuucaggacagcuggagaucgaaguucagacagagaccacgaaggcgggugacaaauugaaggugacuacauucgaaauggcacuaggcccuaccacuaacgucgaucaggccccauaucaagggcgaguguucgcuagcuuuacagccagugcaucucuggaccucgucgauggaagagugagggccguuccccgguccauauucggcuuucaggacgugguaccugaguacaaugauggucugcuugucccacuggcucccccgauugggccuuucuugccaggcgaggugcuccugcguuuucgcaccuauaugagacagaucgacagcucggaugccgcagcggaagcuauugacugcgccuuaccccaggaguucguuucuugguuugcauccaacggauucacggugcaaucagaugcccugcuacucagguaccggaauacccugacaggccagcuuuuguuugaauguaagcuguauagugacggguacaucgcucucagcuauuccggaucugguccucugacuuuccccaccgauggcuuuuucgaggucgugagcuggguaccacgacuuuaccagcuggccucaguggggaguuuggcaacaggacgcacucucaaacaguga

SEQ ID NO: 19367 - RNA, 1623 nt, Artificial Sequence
  derived and/or modified sequence opt3 from capsid_protein__Norovirus__AEK05311
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuugccguuucaccaaggaacgcucccggggagauccuuuggagugccccucugggaccagauuugaaucccuacuuaagccaccuggcgcggauguauaacggcuacgccgguggguucgaagugcaggucauucuagcaggaaaugcuuuuaccgccggcaaaaucauuuucgcagcugugccuccaaacuuuccgacagagggccucucccccucucagguaacuauguucccucauaucauaguugacgugcgccaacuggagccaguccuuaucccccugccugaugugcgaaauaacuuuuaucacuacaaucagucgaacgacucaacgauuaaguugaucgccaugcucuauaccccacugcgugcgaacaaugccggggaagauguguucacagucagcugcagaguucugacuaggcccaguccggacuuugauuucauuuuucucgugccucccaccguagagucccggacaaaaccauucaccgugccuaucuuaacugucgaagagaugacaaacucucgcuuucccauaccacuggagaaacuuuucaccggacccagcggugcauucgugguucagccucagaauggcagauguacgacugacgggguguugcugggaaccacacaacuauccccagucaacauuugcacuuuuaggggcgaugugacccauaucgcugguucacggaauuacacaaugaaccucgccagucugaauuggaacaauuaugacccgaccgaagagauucccgcuccucuugggacgccagauuucguaggaaagauccagggcguucugacucagacaaccaagggcgacgggagcacucgcggacacaaggccacaguguacaccgguucugcacccuuuacgccuaaauugggcuccguccaguucucaaccgacacagaaaacgauuuugagacucaucaaaauaccaaguucgccccagugggggucauccaggacggaagcacaacucaccgaaacgaaccccagcaaugggugcucccgaguuacucuggcgguaauguucacaacgugcaucuggcuccugcgguagcaccaaccuuucccggggagcaguuacuguucuuuagauccacaaugccuggcuguagcggauaucccaauauggaucucgacugccuucugccacaggaguggguccagcacuucuaccaagaagccgcuccugcccagucggauguggcauugcuaagguuuguuaaccccgacaccggccgggugcuguucgaguguaaacuccauaagucuggguaugucacuguggcccacacgggacagcacgaucugguaauuccaccgaacgguuacuuucguuucgacuccugggugaaucaguucuauacacuugcuccuaugggcaacgggaccggacgcagaagggcccuguga

SEQ ID NO: 19368 - RNA, 1608 nt, Artificial Sequence
  derived and/or modified sequence opt3 from capsid_protein__Norovirus__AEP16505
augaagauggccagcuccgacgcugcacccucuaacgauggcgccgcggggcuggugccugaggucaauaacgaaaccauggcucucgagccaguugccggagcaucaaucgccgcuccgcuuacaggucagaauaacgugauugaccccuggauaagaaugaauuucguacaagcaccuaacggcgaauuuacugugaguccaaggaauagccccggggagguccuguugaacuuagaacugggaccugagcuaaauccauuccucgcccaccugucccggauguacaacggcuaugcuggugggguggagguucaggugcuucuggccggaaaugcguuuacggcaggcaaauuggucuucgccgcuauucccccucauuuuccacucgaaaaccugucuccgggccagaucaccauguucccccacgugaucauugauguacgcacacuggagccuguucucuuaccacugcccgacgugcgaaauaacuuuuuccauuacaaucagcaaccugaaccacguaugagacuugucgccauguuguauacuccccugaggucgaacgggucaggagaugacguguuuaccgugagcugccggguccuaacacgcccgaguccugauuucgacuuuaacuaccucguucccccaaccguggaguccaagacuaaaccuuucacacugcccauccuuaccauaggugagcugucuaauagcagauuuccaguacccaucgaugaauuguauacguccccuaacgagggcguggucgugcagccacagaaugggaggucaacucucgacggagaacuguuaggcaccacacagcugguuccgaguaacauuugugcacuccggggucgcaucaaugcucaagugcccgaugaccaccaucaguggaaccuucaggucacuaaugccaacgggaccagcuucgauccuacagaggacgugccagcgccccugggaaccccugacuucuuggccaauauuuacggcguaacgucucagcgaaacccagauaauacuugcagagcacacgacggcguucuagcuacauggucccccaaguuuaccccgaaacuggggucagugguccucggaacuugggaagagagcgaucuggaccuuaaccaaccuacaagguucaccccagugggucuguaugauacgaaucacuuugaccaguggaucuugcccaacuacaguggccggcucacccugaauaugaacuuagccccuucugucgcuccccuguucccaggggagcagauacuauuuuuccguucccauauuccucucaagggaggcacaagcaacggugccaucgauugucugcuuccccaagaauggauucagcacuuuuaccaggagucggcaccaucuccgacugacguggccuugauccgcuauccuaaucccgauaccgggagaguucuguucgaagcuaagcuccugaggccaggcuuuaucacaguggcgaacuucggauuuaaacccauuguagucccuccaaagggcuacuuccgguuugacuccugggugaaucaguucuauucacuugcacccauggggacuggaaacggucgacgcagaguucaauga

SEQ ID NO: 19369 - RNA, 1632 nt, Artificial Sequence
  derived and/or modified sequence opt3 from capsid_protein__Norovirus__AEY77318
augaugauggccagcaaggacgcucccaccaacauggauggcacauccggggcaggacagcuggugccugaggucucuacugccgaaccaaucucaauggagccgguugcgggugcugccacggcagccgcuaccgcaggccaagugaauaugauugaccccuggauaaugaguaacuacguacaggccccucagggggaguucacaaucagcccaaauaacacucccggagauauucucuuugaccuucagcugggcccucacuugaauccauucuuaucccaucuggcucaaauguauaacgguuggguggggaauaugaaagucagagugcuacucgccggaaacgcguuuaccgcaggcaagaucauuaucucuugcguucccccuggcuucgccgcucagaaugugucgauagcccaggcaacaauguuuccacacgucaucgcugaugugaggguacuggaaccgauugaaguuccccuugaggacgugcggaacguccuguuccauaauaacgauucaaccccuacuaugcgcuugaucuguaugcucuacacaccacugcgagccagcgggaguuccucuggaaccgaccccuuugugauugcgggucgugugcugacgugcccuagcccagauuucaauuuucucuucuuaguucccccgaacguugagcagaaaacuaagccuuuuuccgugcccaaucugccacuuaacguauugucaaacaguagagugccuagccugaucaaaucuaugauggucucccaagaccacggccagauggugcaguuccagaaugggaggguuacccuagauggacaacuccagggcacaacucccaccucagccagccagcuguguaagauacgggguacaguguaucaugcaaccgggggacaaggccuuaaccugacggaaauugacggcacuccauaccacgcuuuugagagucccgccccuaucggguucccagauuugggagaaugcgacuggcacauuaaugcuucuccggccaacgcauucacagacgguuccaucauccaucgcauugaugucgcccaggacagcaccuuugcuccccaccucggcacuauacauuauacaaaugcggauuacaacgcaaauguggggcugaucuguucguuagaguggcugucuccuccauccggaggcgcccccaagguaaacccuugggcuauuccaagauaugguucaacccucacggaggccgcacagcuugcucccccgaucuacccuccaggguucggcgaagccauagucuuuuucaugagugacuuucccauugccaauggaagcgauggccuguccgugccuugcaccaucccccaggaguucgucacacacuuugugaacgaacaagcaccaacuaggggagaggcggcuuugcuacacuacgucgacccugauacccaucggaaucugggggaguucaaacucuaucccgaagguuuuaugacaugugugccaaacucuagcggcucagggccgcagacucugccuaucaauggaguuuucaccuuuauuaguugggugucccgcuucuaccagcuuaagcccguaggcacaaccgguccaguccgaagacuggggaucaggcggagcuga

SEQ ID NO: 19370 - RNA, 1626 nt, Artificial Sequence
  derived and/or modified sequence opt3 from capsid_protein__Norovirus__AEY83583
augagaaugagcgacggcgccgcucccaaggcaaacggguccgaggccucuggacaggaucuggugccuaccgcggucgaacaagcuguuccaauccagccgguggccggugcagcccucgcugcacccgccgcuggccagauuaaucagauagacccuuggaucuuccaaaacuuuguacagugcccacuuggggaguucucaauuagucccaggaauacaccuggagaaauccuguuugauuuggccuuaggcccaggucugaaccccuaccuagcgcaccucagcgcaauguauacugggugggugggaaauauggagguccagcuggugcuugccggcaacgcuuucacggccggcaaaguuguggucgcacuggugccuccauacuuuccgaagggguccuugaccacagcucagauuacuuguuucccccauguaaugugcgacguucggacccucgaaccuauccaacugccacugcucgaugugcgccgagucuuauggcacgccacacaggaccaggaggagucuaugcgucugguguguaugcuuuauacccccuugagaacuaauucgccuggagaugaaucauuuguggucagcgguaggcugcuaaguaaaccagcgcccgacuucaacuuuguuuaccucacaccgccuauagagcggaccaucuaucgcaugguggaucugcccguacuucagccaagacugugcacgcaugccagguggccugcacccguguacggcuugcucgucgacccaucccugcccucuaauccucaauggcagaacgggcgggugcagguugauggaacuuuacugggcaccacaccagugagcgguuccugggucucauguuucgcugccgaagcugccuaugaguuucaagcagggacuggagaggugguaaccuucacaaugauugaacaggacggcagugccuacguuccgggcgaucgcgcugcgccccucggguacccugacuuuagcggacagcuugagaucgaagugcagaccgagacgacuaagacaggugacaaacugcgagucaccacuuucgaaaugauuuugggcccaacaaccaauguggaucaagcacccuaucaggggagagccuacgcuucucuaacggccgcagccucccuggaccucgucgauggaagggugcgggcuguuccucguucaaucuauagcuuccaggacgagcugccagaguacaacgauggcgugcuuguaccccuggccccgccuuuggguccauuucuccccggggaaguccuguuacgcuucagaaccuauaugaggcagcuggacacagcagaugcggcugcccaaccuauagacugcgcacuaccccaggaguuuauuaguugguucgccucuaauaacuuuacugugcaguccgaugcucuccugguucgguaccgaaauacccuuacaggccaguugcuguucgaagccaagcucuauagcgagggauacaucgcagugucguacucuggcuccgggccacugacuuuuccuaccgacggauucuuugaagucgugucauggguaccccgccuuuuccaacuggcuaguguggguagcuugguuacaggcagaacccucaagcaguga

SEQ ID NO: 19371 - RNA, 1629 nt, Artificial Sequence
  derived and/or modified sequence opt3 from capsid_protein__Norovirus__AFB18010
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagaacgaacuucguacaagccccuaauggcgaauuuaccgugucaccaaggaacgcucccggggagguccuguugaauuuagaacugggaccugagcuaaacccauaccucgcccaccuggcgcggauguauaauggcuacgccggugggauggaggugcagguuaugcuugcaggaaacgcuuucacagccggcaaacugguguuugcagcugugcccccucauuucccaguggaaaauuugaguccgcagcagaucacuauguuuccccacguaauuaucgauguucgcacccucgagccugugcugcugccacuccccgacguccgaaacaauuucuuucauuauaaccaaaaggaugacccuaaaaugcguauuguggccauguuauacacaccacugagaagcaauggcuccggggaugacguguucaccgucucuugcaggguucuuacucggcccucgccggauuuugacuucacauauuuggugccucccaccguagaauuuaagacgaaaccauucacucugccuauccuaacccucggagagaugucaaacagccgcuuucccgugccaauagaucagauguacacaagucccaacgagaucauuuccguccagugucagaaugguagaugcacucuggacggcgaacuucaagggaccacacagcugcaggucucuggaaucugugcguucaagggccagguuaccgcccacuugcaagauaacgagcaucucuauaaugugacgauuacuaaccugaaugguagcccuuucgacccauccgaagacaucccggcacccuuaggggucccugauuuugagggaaggguguucggcguaauaucacagcgggacaacuacaauaguggcgggcagaaccaaccagcuaaucgcagccacgaugccguugugcccacauacaccgcucaguauacuccuaagcugggacagauucagaucgguacauggcaaaccgacgauauuacggucgaccagccagccaaauuuacccccgugggccucucugauacagaccacuccaaccagugggucgugccgcgauacgcaggggcccuuaaucugaacacuaauuuggcuccuucaguugcgccaguguuccccggagaaagacuacuguuuuucaggagcuauaucccucucaagggcgguuuugggaaccccgcaaucgauugccugguaccacaggaguggauucaacauuucuaccaggaggccgcuccuagucuuucugaagucgcccuggcacgguauauaaaucccgacaccggccgugccuuguuugaggcuaaacuccaccgcgccggauucaugacaguguccagcaacacuucggcaccaguuguggucccggcgaacggcuacuuuagauucgauucuugggugaaucaguuuuauucccuggcuccuauggggaccggaaacgguaggcggcgaauccaguga

SEQ ID NO: 19372 - RNA, 1623 nt, Artificial Sequence
  derived and/or modified sequence opt3 from capsid_protein__Norovirus__AFB18013
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaagugaucuucgcugccguaccuccaaacuuuccgacggagggccucucccccucucagguuaccauguucccucauauuguggucgacgugcgccaacuggagccagugcuuaucccccugccugauguccgaaauaacuuuuaucacuacaaucagucgaacgacccaacaauaaaguugaucgcaaugcucuauacuccccugcgugcuaacaaugccggggaagauguuuucaccgugucaugcagaguacugacaaggccgagcccugacuuugauuucauuuuucucgugcccccaaccgucgagagucggacuaaaccuuucacagugcccaucuuaaccguugaagagaugacgaacucccgcuuuccaauuccccuggagaaacuuuucacuggaccuucuggugcguucgugguccagccacagaauggcagauguaccacagacgggguguugcugggaacuacccaacuaagcccgguaaacaucugcacauuuaggggcgauguuacccauauagccgguacgcacaauuacacuaugaaccucgcaucccagaauuggaacaauuaugaccccacagaagagauuccugcuccacuggggacccccgauuucgugggacggauccagggcaugcuuacucagacaacccgcggcgacgggucaacgcgaggacauaaggccaccgucaguacaggugacgugcacuuuacuccuaagcugggcagcauucaauucaacaccgauacaaauaacgacuuugaaacugggcagaauaccaaguucacaccagucggagugguucaggauggcaacgguacccaccaaaaugagccccagcaguggguguugccgucuuacuccgggagaacuggccauaacguacaccucgcuccugccgucgcaccaacguuucccggagaacagcuguuauucuuuaggucaacaaugccuggcuguagcggguaccccaacaugaaucuggacugccuccuuccacaagagugggugcagcauuucuaucaggaggccgcuccugcgcagagugauguugcacuguugcgguuugugaaccccgacaccggacguguccuauucgaauguaaacugcacaagucugguuacgugacuguagcccacaccggccaacaugaucucgugaucccaccgaauggguauuuucgcuucgacuccuggguuaaccaguucuacacacuggcuccuaugggaaauggcaccgguagaaggcgggcccuuuga

SEQ ID NO: 19373 - RNA, 1743 nt, Artificial Sequence
  derived and/or modified sequence opt3 from capsid_protein__Norovirus__AFJ05624
augaagauggccagcaacgacgcuaccgcacccucccaggauggcgccgcgaaucuggugccugaaucucaacacgaaguccucgcucuugagccaguugccggggcagcccuggcugcaccgguggccggacaguucaacgcuaucgaccccuggauuaaacagaauuuuguacaggccccugcgggugaguucacagugucaccaagaaacgcacccggcgaaauauugauggauuuagaacuggggccugagcuaaauccauuucucgcccaucuggcucaaauguacaacgccuaugcaggaggcauggagguccagaucauucuugcugguaaugccuucacugcggggaagaucauugugugcgccguucccccuaacuuuccaccggacaggcugagugcaagccaggcuacgaauuucccccacgugaucauggauguccggaccuuggaaccugugauacucccacugcccgacguacgcgccggauuuuuccauuacaaccagcugcgagagccucguaugagacucauggcuuuacuguauacaccacuuagggccaauggcacuggcgaugacgcauuuaccguuuccugucggguguugacacgccccaugcaagauuucgaauuuauguuccuggucccgccuaccguggagucuagagugacucccuuuucggucccaacauacccuguuguggagaugaccaacucaagguggcccgcccggaucagcgggaugcacguaaaugcuaaccagacgcuagcggugcaguuccagaauggacgcugcacucucgacggucaacugaugggcaccacacagcuuugugcagccgaugucugccgaaugagagggagguauaccaguacucgggcugaccuggccggaguggaucauacagaccagggcccauccuuggguaccgggcccucugacgauagcguuuccgugccugaagcacgugcccaaacgcgcacuggagucucagcucaccuccagcuggaggaauuaaacggccagccauacgagguguauggcgaacagccggcaccccuggggacaccugacuucagauguaggcucaugggagagcuuguacggcugccaaguaccagccccgcagcgcaaucucgauuucgcgaugcuuucuuugacacuuacggugccuuguucgccccugccguuggcuccacaaccuuuacggugaacaauucaagcaccagugauuucgcuaacgggcagccauuugaguuccuacccauuggagucgaaaucggcaauucugcccaguacgacgaguuugcacugccguccuauaacggugcuauuggggaaaauagacaccucgccccuguggcggccccaggcuuccccggagagaacaucgucuuuuucagcucgaaucugccugugugggauucuacauccgcucagaacaauaggcggauaucaugccuucugcccaacgaauuuguucaacauuucuacgacuugcaggcaccaagucagagcgauguggcccuccugcgcuauguacacccugaguccggcagagucuuauucgaguguaaacuguacagggacggguuucuaacugugaauggagcuucucucgccgaguuccccguuaacgguuauuuucguuucgauagcugggugaaucaguuuuucacccugucaccagucggcacagggaguggacggcgaggcagauccaggaacgcacaauga

SEQ ID NO: 19374 - RNA, 1746 nt, Artificial Sequence
  derived and/or modified sequence opt3 from capsid_protein__Norovirus__AFJ05628
augaagauggccagcaacgacgcugcaucccccucuucagauggcgccgcgaaucuggugccugagaucaacaaugaagucauggcucucgagccaguugccggggcacagcuugccgcuccgguggcaggacaauucaacgccauugaccccuggauaagacagaauuuuguacaggcuccugaaggugaguucaccgugaguccaaggaacgcccccggcgaaauccuguugaauuuagagcuggggccucaccuaaacccauuucuccagcaucuggcgcaaauguacaaugcauaugccggaggcauggagguccaggugguucuugcugguaacgccuucacagcagggaaaauuaucuuugcugccgugcccccucacuucccaccggaacggcugagcgcggcccaggcaacucaguuuccccaugucauuguggauguacgccaauuggagccuaucauacucccacugcccgacguucgacacaaucuguuccauuuuaaccagcagaaugaugaacguaugcaccucguggcuuucuuauacacgccucugagagccaacuccggaucuggcgacgaugucuuuaccgugucgugcagggugcuuacacggccaucacaggacuucgaguuuauguucuugguucccccgacugucgagaagaaaaccguggcuuucagccugccucaacuagccaucggcgaaaugaguaauucccgcuggcccgcaagaauuacagggcucguaguggauccaaggcugccucagguccuucacauccagaacggacgguguacccuggacgguacuuugaugggcacaacccaacucaaccccaaugauauuugccgcauccgaggguauuuuucuagcuccagaccagagcuguuaugugaaaacgaggaaucagccacggaccccaugccuacugagaccgauacagacaaucagccaccggaggugagggcucaggcgcgggcaacucagcguugguucgccguuaccgaacugaacggacaaguguacgaccccuuuggcgaucagccugcuccacucgguguccccgacuucaaggcccgcauacuuggggcacugaugagauugccuggaacaaauccaaccaguaacagcagguuugaggaugccuggguggaaacgaauaaccagacuacauaugcucccgccgcaggcguaguugcgauuaccacuaaugacaacucuuccucaaauuacgcuaacgaucagacaugcgaguucgugccgcuaggcaucgaaauuaccgacagcgccccuuaucaugaguuugaucugccaaguuacgggggagcagccucuuccgguaaucggaaccucgcucccacggucgccccuaccuuccccggcgaggcaauccugcuuuuugggagcaauaugccaguguacaaccgaaacacaggaacuucgaauaaagacauccgcugucuguugccuaacgaauauguccaacaccucuacgauacccaggcucccucucuguccgacguggccuuaguuagauaugugaauagggauacaggccggguacuguucgaggcgaagcuacaucgcgacgguuuuaugacugucaacgccucaaguaccacagugcucccaguugacggguacuucagauuugauagcugggugaaucaguucuaugcucuguccccggucggcaacgcaucuggaaggcguggccggagccgacagaccaauuga

SEQ ID NO: 19375 - RNA, 1623 nt, Artificial Sequence
  derived and/or modified sequence opt3 from capsid_protein__Norovirus__AFJ24945
augaagauggccagcaacgacgcuaaucccuccgauggcucugcagccucacuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucaguacagacacugaaaaugauuuugagacccaucaaaacacaaaguucacuccagugggcgucauccaggacgggucuaccacacaccgaaaugaaccccagcaaugggugcucccguccuacagcggaggcaacguucacaaugugcaucuggccccugcaguagcuccaaccuuucccggugagcaguuacuguucuuuagaucgacuaugccuggguguucuggcuaucccaacauggaucucgacugccuucugccacaggaguggguccagcacuucuaccaagaagcggccccugcacaguccgauguggcuuugcuaagguuuguuaaucccgacacgggacgggugcuguucgaguguaaacuccauaagucaggcuaugucacaguggcccacaccgggcagcacgaucugguaauuccaccgaacggauacuuucguuucgacaguugggugaaccaguucuauacucuugcaccuauggguaauggcaccgggcgcagaagggcccuguga

SEQ ID NO: 19376 - RNA, 1638 nt, Artificial Sequence
  derived and/or modified sequence opt3 from capsid_protein__Norovirus__AFK75851
augaugauggccagcaaggacgcucccccuaacauggauggcaccuccggggcaggacagcuggugccagaggccaauacagcggaaccgaucucuauggagcccgucgcuggugccgcaacugccgcugcaacggccggccaaguuaacaugauugacccuuggauaaugaauaacuacgugcaggcuccacagggggaguucaccaucucacccaauaacacaccuggagauauucucuuugaccuucagcugggcccacacuugaaucccuucuuaagucaucuggcccaaauguauaacgguuggguagggaauaugaaagugaagguccuacucgcgggaaacgcauuuacugccggcaaaaucauuaucagcugcauaccuccaggcuucgcugcccagaauaucuccauugcacaggcuaccauguuuccgcacgugaucgccgauguuagagugcuggaacccauugaagucccucuugaggacgugaggaacguacuguuccauaauaacgauaauacaccaaccaugcgguugguuuguaugcucuacacuccccugcgcgcgucugggucgucaagcggaacagacccuuuugugaucgccggucgaguccugaccugcccaagucccgauuucuccuuucucuucuuagugccgccuaacguggagcagaagacgaaacccuuuucugucccaaaccugccucuuaauacuuugagcaacucccguguucccucacugauaagaaguaugauggugagcagggaccacggccaaaugguacaguuccagaaugggcgggugacccuagauggacagcuccaaggcacaacuccaaccucugcaucccagcuguguaagauucgcgguucagucuuucaugcuaacgggggaaauggcuauaaccuuacagaacuggacggcagccccuaccacgccuucgagaguccugcuccaaucggguucccggauuugggagaaugcgacuggcacauggaggccucucccaccacgcaguuugacacuggugaugugauuaagcaaaucaauguuaaacaggaggcagccuucgcuccucaucucggcacaauccaggcggacgggcuguccgaugugagcgucaacaccaauaugauugcaaaguuaggaugggugucgccaguaucugacggccacagagguuccguugaucccugggugauaccuagguaugggucaacucugacagaagccgcucagcucgccccacccaucuacccgccuggcuuuggagaggcaauugucuucuuuaugagugacuucccaaucgcccauggcgcuaacgggcuuagcgugcccuguaccauaccucaagaauuugucacgcacuucgugaaugagcaggcccccacccggggagaagcagcgcuguugcacuaucuagauccagacacacaucgcaaccugggugaguuuaaacucuacccugagggcuucaugacuugcguucccaauuccucugggaccggaccacagacacugccgauuaacggcguguuugcuuucguaagcugggucucacgauuuuaccagcuuaagccuguggguacugccgggcccgcaagaaggcugggcauccggcguaguuga

SEQ ID NO: 19377 - RNA, 1635 nt, Artificial Sequence
  derived and/or modified sequence opt3 from capsid_protein__Norovirus__AFK75852
augaugauggccagcaaggacgcuacccccuccgcagauggcgccacaggggcgggacagcuggugccugaggucaacacugcugacccaaucccgauugaucccguugccgguucuucaacggcacucgccaccgcuggccaagugaaucuuauagacccuuggaucauuaacaauuucguacaggcaccacagggggaauuuacaaucagucccaacaauacuccuggagaugugcuguucgacuugcaguuaggcccacaccugaaccccuuucuaagccaucucucccaaauguacaaugguugggucgggaacaugagagugaggguugugcuggccggaaaugcuuucaccgccggcaaagucauuaucugcugugugccuccaggcuuucagucucggacacuuucgauagcgcaggcaacccuguucccgcacguaaucgccgauguucgcacuuuggaccccguggaggucccucucgaagaugugcgaaacgugcuguaucauaauaacgacacacagccaaccaugcgucugcucugcauguuauacacgccccugagaacugggggagcuucagguggcaccgauagcuuugucguugccgggagggugcuuacauguccuggaccagacuucaacuuuuuguuccugguacccccgacuguggagcaaaagacccggccuuuuacaguccccaauauuccacuaaaauaucucaguaauucccgcaucccuaaccccauugaaggcaugucucugagcccagaucagacccagaacgugcaguuccaaaaugguagaugcacgaucgacgggcagccccuuggaacuacaccuguuuccgugucacagcuguguaaguuuaggggccggauaaccaguggccaaaaagucuugaaccucacugagcuggacgggagcccauucauggcauucgcugccccggcgcccgccggauuuccugauuuagguucuugcgacuggcacauugagauguccaagaucccaaauucaagcacacagaguaaccccauugugguaaauucuguuaagccuaacucccagcaguucgugccacaucugagcucgaucacccucgaugacaaugucucuuccggcggggauuacaucggaacgauucaauggaccucacccccgagugacagcggcggugcaaacacaaauuuuuggaaaauaccugauuauggguccucucuugcugaagccagccagcuggcuccagccguguaucccccuggcuucaacgaggucaucguguacuuuauggcaucaauucccggaccaaaucagaguggcuccccuaacuugguucccugucuacugccacaggaauacaucacucacuucauaagcgagcaagccccgauucagggggaggcugcgcuccugcacuacguggacccugauaccaaucgcaaccuuggagaauuuaagcuguaucccgguggcuacuugacaugcguaccaaauucuucaaguacugggccccagcagcucccucuggacggagucuucguguuugcaagcuggguuucccgauucuaucaauuaaaaccagugggcaccgccggucccgcuagagggaggcugggcguccggcguuga

SEQ ID NO: 19378 - RNA, 1641 nt, Artificial Sequence
  derived and/or modified sequence opt3 from capsid_protein__Norovirus__AFK75853
augaugauggccagcaaggacgcuucccagucugcagauggcgccucaggggcgggacaacuggugcccgaggucaacaccgcugacccucucccaauggaaccgguugccggucccacaacugcaguggccacggcuggccagguaaauaugaucgauccuuggauugugaacaauuucguccagaguccacagggggaguuuaccauaagccccaacaauacaccuggagacauccuuuucgaucugcaauugggcccacacuuaaaccccuuucugucccaucuaucucagauguacaaugguuggguggggaacaugagaguuaggauucuccuggcaggaaaugccuucucggcuggcaaaaucauugugugcugugucccuccaggcuuuacuucaagcagucuuaccaucgcccaggcgacacuguucccgcacgugauagcagacguacggaccuuggaacccaucgagaugccucucgaagauguucgcaacgugcuguaucauacuaaugacaaccagccaacaaugcgacuggucugcaugcucuacacccccuuacguaccgggggagguuccggcaauucugauagcuuugugguggccgggagaguccugacugcuccuuccucagacuucaguuuucuuuucuugguuccacccaccauugagcaaaagacaagggccuuuacugugccgaacaucccucugcagacccuaagcaauucucgguuccccucccucauucagggaaugauccugucaccagaugcaagccagguagugcaauuucagaacggccgcugucuuauagacggucagcuguuggggacaaccccugcuacgaguggacaacucuucagagucaggggcaaaauuaaccagggcgcccggacucugaauuuaacagagguggaugggaagcccuucauggcguuugacucuccagcccccguuggauucccugacuuugguaaaugcgauuggcacaugcgcaucuccaagaccccaaacaauacuagcucgggcgacccgaugcgaucuguguccguccagacaaacgugcagggguucguaccccaucugggaucaauucaauuugaugaaguuuucaaucacccuaccggcgacuauaucgguacgaucgaguggauuagucagccaagcacgcccccugggacagauauaaaccucugggaaaucccagacuacggcuccucucuuagccaggcagcuaaucuggcucccccgguguuuccuccaggauucggcgaggccuuggucuauuuugugucagccuuccccgggccuaacaauagaagugcacccaacgaugucccaugucuacugccucaggaguacauuacucacuuuguguccgaacaagcccccaccaugggagacgcugcgcuccugcauuauguugauccagacacaaauaggaaccuuggugaguucaagcuguacccgggcggguacuugacuugcgugccuaauggaguaggcgcagguccccagcagcucccacugaacggggucuuuuuauucgugagcuggguuucucgguucuaucagcugaaacccgugggcaccgccucaacagcucguggacgccuaggcgucagaaggaucuga

SEQ ID NO: 19379 - RNA, 1647 nt, Artificial Sequence
  derived and/or modified sequence opt3 from capsid_protein__Norovirus__AFK75854
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccggcaaaguuauuuucgcagcuaucccuccuaacuuuccaauagacaaucuuagugccgcgcagaucacgaugugcccgcaugugauugucgaugugcggcaacuggagcccaucaacuugccuaugccagacguacgcaauaccuucuuucacuauaaccaggauagcgacucccgacuccgucugauugccaugcuguacacaccccucagagcaaacaauucuggggaugacguuuucacugugucguguagggucuuaacccggccuucaccagauuuuagcuucaacuuucuggugcccccgacaguggaaaguaagaccaaacuuuucacuuugccuauccugacaauauccgagaugucuaauagccgcuuucccgucccaauugacucccuacauaccucaccuacggaaaacaucguugugcagugccagaauggaagaguaacucucgauggugagcugaugggcaccacacaacuucugcccagucagauuugugcuuucagggggacuuugacccggagcacaucucgcgccuccgaccaggcugacaccccaacgccccgacucuucaaccacagauggcauauccagcuggauaauuuaaacggaacuccuuaugacccagccgaggauaucccggcaccccugggcacaccugacuuuagggguaagguguucggggucgccucacaacggaauccagauagcaccacucgugcucacgaagcgaaaguggacacaaccaguggacgcuuuacgcccaagcucggcucucuugagauuaccacagaauccgaugacuucgauacuaaccagagcaccaaguuuacaccuguuggcauagggguggacaaugaggcagaguuccagcaauggucgcugccaaacuacucuggacaguuuacucacaauaugaacuuggcccccgcugucgccccgaauuucccuggugaacagcuacuguuuuucagaucccagcucccaucaaguggcggguggagcaacggagugcuggauugccuuguaccccaagaguggguucagcauuuuuaucaggaauccgcacccgcccagacccaaguggcucuggucagguacgugaaccccgacacaggccgggucuuguucgaggccaaacuccacaagcuggguuuuaugaccaucgcgaaaaauggggacucuccaauuacugugccucccaacggcuacuuccgauucgaaagcuggguuaauccauuuuauacguuagcaccgaugggaacaggcaacgggcgcagaaggauccaguga

SEQ ID NO: 19380 - RNA, 1671 nt, Artificial Sequence
  derived and/or modified sequence opt3 from capsid_protein__Norovirus__AFN61315
augaagauggccagcuccgacgcugcacccucugccgauggcgcggggaaccuggugccugagucacagcaagaaguccucccacuugcuccgguugccggagcagcccuggcugcacccgugguaggucagaccaauaucauugacccuuggauaaaagagaacuucgugcaggccccacagggcgaauuuacagucagucccaagaauagcccuggggagaucuuggugaacuuagaacugggaccaaaacuaaaucccuaccucgaucaccuguccagaauguauaacucuuacgcuggcgguauugacguuauggugguccuugccgggaaugcguucacugcaggaaaggugcugaucgccgcuauuccuccaaacuuuccgguagagggcguuucggccucacaagcaacgcaguucccccaugugaucauagaugucaggaccuuggacccugugcggcucccacugcccgaugugcgcagcacauuuuuccacuauacuaaugacaccgagccuaaaaugcgacuggucaucuggcucuacacaccauuacguaccaacggcaguggggaugacuccuuuacuguuucuggaaggauucugacaaggcccagccaggauuucgaauuugcuuuccuuaucccgccuaccguggagacgaagacuacccccuuuuccguaccagguuucucagugcaggaaaugaguaauagccgguggccugccgcgauuucugccauggucgugcgcggcaacgagccccaaguugugcaguuucagaaugggagagcacauuuggacggaaugcugcuaggcacaacuccagucucccccaacuauaucgcuucauacagggguauaagcaccgggaauagucggucugccuccagcgaggcugaugaacgcgccgugggaucguucgacguauggauucgacuccaggagccugacggccaaccauaugauaucuucggcaagcagccggcacccauugggacaccugacuuuaaagccguuaucgugggauucgcugcgagaccacugaccucugguuccuacgcaaacgaagccuacgucaacacgacugcuucagauuaugcccccgcaacaggcaauaugagguuuaccgugcggaacgggggaacuggccacaucagugccaauaaguacugggaguuccguagcuuuggugucgaaggggagcgccauacagacgugcaguaucaagaguacgaacuuccugauuauuccggccagguugcuucuaaccacaaucuggccccacccguggcaccgagaaugccuggagagagcuugcuccuguuccagucaaacaugccaguaugggacgauggcagaggggaaaguacccccaaaaagauucacugcuuacugccucaggaguuuauaggacauuucuuugacaaacaagcgcccucccucggugaugcugcccuucugcgguacgucaaucaggaaacgaaccgaguguuguucgaguguaagcuauaucgcgacggcuacaucaccguugcagccgcuagcgggcugcucgauuuuccacuggacggauucuuuagauucgacucuugggugucaaguuucuacauucuuagcccugucggcuccggucaggggaggcggggccgcgugagauuucaguga

SEQ ID NO: 19381 - RNA, 1623 nt, Artificial Sequence
  derived and/or modified sequence opt3 from capsid_protein__Norovirus__AFQ00511
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagucuggcuaugucacaguggcccauaccgggcagcacgaucugguaauuccgccuaacggauacuuucgcuucgacuccugggugaaucaguucuauacucuugcacccauggguaacggcaccgggagaaggcggguucuguga

SEQ ID NO: 19382 - RNA, 1623 nt, Artificial Sequence; identical to SEQ ID NO: 18261
  derived and/or modified sequence opt3 from capsid_protein__Norovirus__AFQ00512

SEQ ID NO: 19383 - RNA, 1623 nt, Artificial Sequence
  derived and/or modified sequence opt3 from capsid_protein__Norovirus__AFQ00513
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucacugugccuaucuuaacagucgaggaaaugaccaacucucgcuuucccauaccacuggagaaacuuuucacgggacccagcuccgccuucgugguucagccucagaaugguagauguacuaccgauggcguguugcuggggacaacucaacuaucaccagucaacauuugcaccuuuaggggagacgugacacauaucgcaggcagucggaauuacaccaugaaccucgcuagccugaauuggaacaauuaugauccgacggaggaaauucccgccccucuugguacuccagacuucguagggaagauccagggaguucugacacagaccacuaagggcgacggcucuacacgcgggcacaaggcuaccguguacacgggauccgcccccuuuaccccuaaauuggguucaguccaguucagcacagauacugagaacgacuuugaaacccaucaaaauacaaaguucacuccagugggcgucauccaggaugggaguaccacacaccgaaacgagccccagcaaugggugcucccgucuuacuccggaagaaauguucagaacgugcaccuggccccugcaguagcuccaaccuuucccggcgaacaguuacuguucuuuaggagcacuaugccugguuguucgggguaucccaauauggaccucgauugccuucugccacaggaguggguccaacauuucuaccaggaggcggccccugcacagucugacguggcuuugcuacgguuuguuaaccccgauacgggccgugugcuguucgaauguaaacuccacaaguccggauaugucacaguggcccauaccggccagcacgaccugguaauuccaccgaacggguacuuucgcuucgauucaugggugaaucaauucuauacucuugcaccuaugggaaacgguaccggcagaaggcgggcccuguga

SEQ ID NO: 19384 - RNA, 1623 nt, Artificial Sequence
  derived and/or modified sequence opt3 from capsid_protein__Norovirus__AFQ00516
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaucaaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaaaucauuuucgccgcagugccuccaaauuuuccgacugagggccucucucccucgcagguaacgauguucccucauaucauaguugacgugcgccaacuggagccaguccuuaucccccugccugaugugcgaaacaauuuuuaucacuacaaccagucaaaugacagcaccauuaaguugaucgcuaugcucuauacaccacugcgugccaacaacgcgggggaagauguguucacugucaguugcagaguucugaccaggcccuccccggacuuugauuucauuuuucucgugccucccacaguagagucucggaccaaaccauucacugugccuaucuuaacagucgaagagaugaccaauagccgcuuucccauaccacuggagaaacuuuucacgggacccuccucagccuucgugguucagccucagaacgguagauguacuaccgacggcguguugcuggggacaacucaacuaaguccagucaauauuugcaccuuuaggggagaugugacacauaucgcaggcagccggaacuacaccaugaaucucgcuucucugaacuggaauaacuaugacccgacggaagagauucccgccccucuugguacuccagauuucguagggaagauccagggaguucugacacagaccacuaagggcgacggcuccacacgcgggcacaaggcuaccguguacacgggaucagcccccuuuaccccuaaauuggguagcguccaguucggcacagacacugaaaaugauuuugagacccaucaaaacacaaaguucacuccagugggggucauccaggacggaggcaccacacaccgaaaugaaccccagcaaugggugcucccgaguuacucugguagaaacguuccuaaugugcaccuggcaccagccguagcucccaccuuuccuggggagcaguuacuguucuuuagguccacuaugcccggcuguagcggauauccaaacauggaucucgacugccuucugccucaggaguggguccagcauuucuaccaagaagcggcacccgcccagucggauguggcuuugcuacgguuuguuaauccagacacgggccgugugcuguucgaguguaaacuccacaagucuggguaugucacaguggcccauaccggacagcacgaucugguaauuccgccuaacgguuacuuucgcuucgacuccugggugaaccaguucuauacucuugcacccaugggcaaugggaccggaagaaggcgggcccuguga

SEQ ID NO: 19385 - RNA, 1623 nt, Artificial Sequence; identical to SEQ ID NO: 18261
  derived and/or modified sequence opt3 from capsid_protein__Norovirus__AFQ00517

SEQ ID NO: 19386 - RNA, 1623 nt, Artificial Sequence; identical to SEQ ID NO: 18926
  derived and/or modified sequence opt3 from capsid_protein__Norovirus__AFQ00518

SEQ ID NO: 19387 - RNA, 1623 nt, Artificial Sequence
  derived and/or modified sequence opt3 from capsid_protein__Norovirus__AFQ00519
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacucgcggcgacggcucuacacgagggcacaaggcuaccguguacacgggauccgcccccuuuaccccuaagauggguucaguccaguucagcacagacacugaaaacgauuuugagacccaucaaaauacaaaauucacuccagugggcgucauccaggacgggggaaccacacacagaaacgaaccccagcaauggguguugccgaguuacucuggcaggaauguuccuaacgugcaccucgcaccagccguagcucccaccuuuccuggugagcagcuguuauucuuucgguccacuaugcccggguguagcggcuauccaaauauggaucuggacugccuccuuccucaggaguggguccagcauuucuaccaagaagcggcacccgcccagucggauguggcucuguugcguuuuguuaacccagacacgggacgcgugcuauucgaguguaagcugcacaaaucuggcuaugucacaguggcccauaccgggcagcacgaucucguaauuccgccuaacggauacuuuagauucgacuccugggugaaucaguucuauacucuggcacccauggguaacggcaccgggaggcggcgagcccuuuga

SEQ ID NO: 19388 - RNA, 1623 nt, Artificial Sequence
  derived and/or modified sequence opt3 from capsid_protein__Norovirus__AFQ00520
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaaugcugacacagaccacuaagggcgacggcucuacacgcgggcacaaggcuaccguuuacacgggauccgcccccuuuaccccuaaauuggguucagugcaguucagcacagacacugaaaacgauuuugagacccaucaaaauacaaaguucacuccagucggcgugauccaggacgggaguaccacacaccgaaacgaaccccagcaauggguccucccgucuuacuccggaagaaaugugccuaacguucaccuggcaccagccguggcucccaccuuuccuggcgagcaguuacuguucuuuaggagcacuaugcccgguuguucgggguauccaaauauggaucucgacugccuucugccucaggaguggguacagcauuucuaccaagaagcggcacccgcccagucugaugucgcuuugcuacgguuugugaacccagacacgggccguguucuguucgaguguaaacuccacaagccgggauaugugacagucgcccauaccggccagcacgaucuggugauuccucccaacggguacuuucgcuucgacuccuggguaaaucaguucuauacucuugcaccaaugggaaacgguaccggcagaaggcgggcccuguga

SEQ ID NO: 19389 - RNA, 1623 nt, Artificial Sequence
  derived and/or modified sequence opt3 from capsid_protein__Norovirus__AFQ00521
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguucagaacgugcaccuggccccugcaguagcuccaaccuuucccggugagcaguuacuguucuuuagguccacuaugccuggguguagcggcuaucccaauauggaucucgacugccuucugccacaggaguggguccaacauuucuaccaggaagcggccccugcacagucggauguggcuuugcuacgguuuguuaaccccgacacgggacgugugcuguucgaguguaaacuccacaagucuggcuaugucacaguggcccauaccgggcagcacgaucugguaauuccaccgaacggauacuuucgcuucgacuccugggugaaucaauucuauacucuugcaccuauggguaacggcaccgggagaaggcggguucuguga

SEQ ID NO: 19390 - RNA, 1623 nt, Artificial Sequence
  derived and/or modified sequence opt3 from capsid_protein__Norovirus__AFQ00522
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccaguucagcacagacacugaaaacgauuuugagacccaucaaaauacaaaguucacuccagugggcgucauccaggacgggggaaccacacaccgaaacgaaccccagcaaugggugcucccgaguuacucuggcagaaauguuccuaacgugcaccuggcaccagccguagcucccaccuuuccuggugagcaguuacuguucuuuagguccacuaugcccggguguagcggcuauccaaauauggaucucgacugccuucugccucaggaguggguccagcauuucuaccaagaagcggcacccgcccagucggauguggcuuugcuacgguuuguuaacccagacacgggacgugugcuguucgaguguaaacuccacaagccgggcuaugucacaguggcccauaccgggcagcacgaucugguaauuccucccaacggauacuuucgcuucgacucuugggugaaucaguucuauacucuugcaccaauggguaacggcaccgggagaaggcgggcccuguga

SEQ ID NO: 19391 - RNA, 1623 nt, Artificial Sequence; identical to SEQ ID NO: 19390
  derived and/or modified sequence opt3 from capsid_protein__Norovirus__AFQ00523

SEQ ID NO: 19392 - RNA, 1623 nt, Artificial Sequence; identical to SEQ ID NO: 18926
  derived and/or modified sequence opt3 from capsid_protein__Norovirus__AFQ00524

SEQ ID NO: 19393 - RNA, 1623 nt, Artificial Sequence; identical to SEQ ID NO: 18926
  derived and/or modified sequence opt3 from capsid_protein__Norovirus__AFQ00525

SEQ ID NO: 19394 - RNA, 1623 nt, Artificial Sequence
  derived and/or modified sequence opt3 from capsid_protein__Norovirus__AFQ00526
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucacaauuacgcuaugaaccucgccagccugaauuggaacaauuaugacccgaccgaagagauucccgcuccucuugguacgccagauuucguagggaagauccagggaguucugacucagacaaccaagggcgacggcucuacucgggggcauaaggccacaaucuacaccggauccgcacccuuuacgccuaaauuggguucagugcaguucagcaccgacacagaaaacgauuuugagacucaccaaaauaccaaguucacaccagucggcgugauucaggacgggggaacuacccaccgcaacgaaccccagcaauggguccucccgaguuacucuggccgaaaugugccuaacguucaucuggccccagcuguggcgcccacauuuccuggugagcaguuacuguucuuuagauccaccaugcccggguguagcggcuauccaaauauggaucucgacugccuucugccucaggaguggguacagcacuucuaccaagaagcagcccccgcucagucggaugucgccuugcuaagguuugugaacccagacacuggacggguucuguucgaguguaaacuccauaagucuggcuaucugacgguggcacacacagggcagcacgaucuugucauaccgccuaacggauacuuucguuucgacuccugggugaaucaguucuauacccuggcccccauggguaacggcacugggcgcagaagggcuuuguga

SEQ ID NO: 19395 - RNA, 1623 nt, Artificial Sequence; identical to SEQ ID NO: 18926
  derived and/or modified sequence opt3 from capsid_protein__Norovirus__AFQ00527

SEQ ID NO: 19396 - RNA, 1623 nt, Artificial Sequence
  derived and/or modified sequence opt3 from capsid_protein__Norovirus__AFQ00528
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacccaaccauuaaguugaucgcuaugcucuauacaccccugcgugccaacaaugcgggggaagauguguucacugucucaugcagaguucugaccaggccgagcccugacuuugauuucauuuuucucgugcccccaacaguagagagucggaccaaaccuuucacugugcccaucuuaacagucgaagagaugaccaacucccgcuuuccaauaccccuggagaaacuuuucacgggaccuucuagcgccuucgugguucagccacagaaugguagauguacuaccgacggcguguugcuggggacaacucaacuauccccggucaacauuugcaccuuuaggggagaugugacacauaucgcaggcucacggaauuacaccaugaaccucgcuagucugaauuggaacaauuaugaccccacggaagagauuccugccccacuugguacucccgauuucguagggaagauccagggaguucugacacagaccacuaagggcgacggcagcacacgcgggcacaaggcuaccguguacacgggaucugccccuuuuaccccaaaauuggguuccguccaguucucaacagacacugaaaacgauuuugagacccaucaaaauacaaaguucacucccgugggcgucauccaggacgggggaaccacacaccgaaacgaaccgcagcaaugggugcucccuagcuacaguggcagagauguuccaaaugcacaccuggcccccgcuguggcgccuaccuuucccggugagcaguuacuguucuuuaggucuacuaugccaggguguuccggcuauccuaacauggaccucgauugccuucugccccaggaguggguacagcauuucuaccaagaagcagccccagcucagagcgacgucgccuugcuacgguuugugaauccggauacgggacguguucuguucgaguguaaacuccacaagucgggcuaugugacagucgcacauaccgggcagcacgaccuggugauuccucccaacggauacuuucgcuucgauucuuggguaaaccaguucuauacucuugccccaauggguaauggcaccgggagaaggcgggcucuguga

SEQ ID NO: 19397 - RNA, 1644 nt, Artificial Sequence
  derived and/or modified sequence opt3 from capsid_protein__Norovirus__AGC66782
augaagauggccagcaacgacgcugcacccuccaaugauggcgccgcgaaccuggugccugaggcuaauaacgaagucauggcccucgagccaguugugggggcaucuaucgccgcuccgguagugggacagcaaaauauuauagaccccuggaucagagaaaacuucguccaggcaccucagggugaguuuaccgugucaccaaggaauagucccggcgaaaugcuucugaacuuggaguuagggccugagcugaauccauaccuaagccaccucucccggauguauaacggauacgccggcgguaugcagguucaagugguccuggcugggaaugccuucacagcgggaaaaauuaucuuugcagccgugcccccucauuucccaguagaaaacauuucugcugcccagaucacuaugugcccgcacguuauaguggauguccgccagcuugagcccgugcuguugccucucccagacauccgaaauagauuuuuccauuauaaccaggaagauacgccccguaugaggcugguggcaaugcuguacaccccucuccgggcuaauucgggcgaggacgucuuuacaguuucaugucgcguguuaacuagaccagcccccgauuucgaguuuaccuuccugguaccgccuacaguggaaagcaagaccaaacccuuuacucuuccaauuuugacacugggcgagcuaaguaacuccagguucccugcgcccaucgacaugcucuauaccgauccaaacgaaacgauugucgugcaaccccagaucgggcggugcacucuggacggaucucuucaggguaccacacagcugguuccuacucaaauauguagcuuuggcgggaccuugauuucccagacaucacgcagugccgauagcaccgacucugcaccacgagugagaaaucacccgcuccauguccagcugaagaacuuagauggaacgcccuacgacccuacugacgaggugccagcuguacugggcgccaucgauuucaaagguacaguuuucgggguggcuucccaaaggaauaccacuggaggcucagucggcgccacacgggcacacgaagugcacauugacaccacgaacccccguuauaccccuaagcucgggagcgcccuuauguacagugagucugaugacuuugaugacggacagccaacacgcuucacucccaucgguaugggcgcugaugacuggcaucagugggagcugccggaauacuccgggcacuugacccuaaauaugaaccuggcgccugcagucgccccagcuuuucccggagagagaauccucuucuuuaggagcgugguuccuucggccggcgguuaugggucuggccagauugauugccugauaccccaagaaugggugcagcauuucuaccaggaggcagccccaucccagucagcuguagcccuuauccgguaugucaauccugacacaggacgaaacauucuggaagcaaaguugcaccgcgagggcuuuaucacuguggcgaauagugggaacaaucccauaguugugccaccgaacggauacuucagauuugaggcuugggucaaucaauucuauacccucacaccuauggguaccggccaggggaggcggcgcgugcaguga

SEQ ID NO: 19398 - RNA, 1623 nt, Artificial Sequence
  derived and/or modified sequence opt3 from capsid_protein__Norovirus__AGC66784
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguuccgacuuugauuucauuuuucucgugccgccuacaguagagucucggaccaaacccuucacugugccaaucuuaacagucgaagagaugaccaacagccgcuuuccuauaccccuggagaaacuuuucacgggaccauccucagccuucgugguucagccccagaaugguagauguacuaccgacggcguguugcuggggacaacucaacuaaguccugucaauaccugcacauuuaggggagaugugacccauauugcaggcagccggaacuacacgaugaaccucgcuucucugaauuggaacaauuaugacccaacugaagagaucccggcaccccuugguacaccugauuucguagggaagauucagggaguucugacccagacuacaaagggcgacggcuccacccgcgggcacaaggcuacgaucuacaccggaucagccccauuuacacccaaauuggguagcgugcaguucaacacugacaccgaaaaugauuuugagacacaucaaaacacuaaguucaccccugucggcgugauccaggacgggggaacaacccaccgaaaugaaccacagcaauggguccuccccaguuacucuggcagaaacauuccgaaugugcaccuggccccugccguugcuccaacuuuucccggugagcaguuacuguucuuuagguccacgaugccuggguguagcggcuaucccaacauggaucucgacugccuucugccacaggagugggugcagcauuucuaccaagaagcggccccugcacagucggauguagcuuugcuacgguuugucaaccccgacacaggacgugugcuguucgaguguaaacuccacaagucuggcuauguuaccguggcccauacugggcagcacgaucuggucauaccaccgaauggauacuuucgcuucgacuccugggugaaccaguucuauacccuugcaccuauggguaauggcacagggagaaggcgggcccuguga

SEQ ID NO: 19399 - RNA, 1647 nt, Artificial Sequence
  derived and/or modified sequence opt3 from capsid_protein__Norovirus__AGC66785
augaagauggccagcaacgacgcuacccccuccaaugauggcgcagccgggcuggugccugagaucaacucugaagcgauggcucucgagccagucgccggagcagccauugcugcaccgcuuacaggucagcaaaauauaaucgaccccuggauuaugaacaauuucguucaggccccuggcggggaauuuacugugucaccaagaaacagucccggagagguacuguugaauuuagaacugggcccugagaucaacccauaccuagcucaccucgccaggauguauaaugguuacgcagggggauucgaggugcaggucgugcuggcgggcaacgccuuuacggcuggcaaaauuaucuucgccgcaauacccccuaauuuuccaaucgauaaccuuagcgcugcccagauuaccaugugcccgcauguuaucguggacguccggcaacuggaacccgugaauuugccuaugccagauguacgcaacaauuucuuucacuauaaccagggguccgacucucgacuccgucugauugcgaugcuguacacaccccucagagccaacaauucgggagaugacguuuucacugugucauguagggucuuaacccggccuagcccagauuuuaguuucaacuuucuggugcccccgacaguggaguccaagaccaaaccuuucucucuucccaucuugacuauaagcgaaauguccaauucacgcuuuccagucccuauugacagucugcauacaagccccaccgagaacaucguugugcagugccagaaugguagaguaacgcuagauggcgagcucauggggacuacccaacugcuuccaucucagauuugugcauucaggggaaugcugacacgguccacuucacgcgcuagcgaccaggccgauaccgcuacaccccgauuguucaacuauuacuggcacauccagcucgacaaucugaacggcaccccuuaugacccagccgaagauaucccgggucccuuagggacgccugacuuuagaggaaagguguucggcgucgcaagucaaaggaauccagaugccacuacacgggcucaugaggcgaaaauugacaccacuucuggccguuuuacacccaagcuggggucccucgaaauaagcaccgagucgggagauuucgaccagaaccagccuacgcgcuuuaccccaguggguaucggcguugauagagaagcagacuuccaacaguggacacuucccgauuacgccgggcaguuuacucacaauaugaaccuggcuccggccguggcaccuaauuucccaggagagcaguugcuauuuuucaggucucaacugcccuccucaggcggucggaguaacgggauucucgacugccuggucccucaggagugggugcagcacuuuuaccaggaaagcgcccccucccaaacccagguagcucuuguucgauauaucaauccagauacaggccgcgugcuguucgaggccaaguugcauaaacucggauuuaugacuauagcaaagucuggcgacagcccuauuaccgugcccccaaacggguacuucagauucgaaucaugggucaacccguuuuauacacuggcgccuaugggaaccgguaauggcaggcggcgcauccaguga

SEQ ID NO: 19400 - RNA, 1644 nt, Artificial Sequence
  derived and/or modified sequence opt3 from capsid_protein__Norovirus__AGC66786
augaagauggccagcaacgacgcugcacccuccaaugauggcgccgcgaaccuggugccugaggcugacaaugaagucauggcccucgagccaguugugggggcaucuaucgccgcuccgguagugggacagcaaaacauuauagaucccuggaucagagaaaauuucguccaggcaccucagggugaguuuaccgugucaccaaggaacagucccggcgaaaugcuucugaauuuggaguuagggccuggacugaacccauaccuaagccaccucucccggauguauaauggcuacgccggugggaugcagguucaagugguccuggcuggaaacgccuucacagcgggcaagauuaucuuugcagccgugcccccucauuucccaguagagaauauuucugcugcccagaucacuaugugcccgcacguuauaguggacguccgccagcuugaacccgugcuguugccucucccagauauccgaaacagauuuuuccauuauaaucaggaggacacgccccguaugaggcugguggcaaugcuguacaccccucuccgggcuaacucgggcgaagaugucuuuacaguuucaugucgcguguuaacuagaccagcccccgacuucgaguuuaccuuccugguaccgccuacaguggagagcaagaccaaacccuuuacucuuccaauuuugacacugggggaacuaaguaauuccagguucccugcgcccaucgauaugcucuauaccgacccaaacgagacgauugucgugcaaccccagucuggacggugcacucuggaugguacccuucagggcacaacucagcugguuccuacccaaaucuguagcuuucgcgggacauugauaucccagaccucacgaagugccgacagcacggauucugcaccaagagugaggaaccacccgccccauguccagcucaagaaucuggacggaacuccuuacgacccaacagaugaagugcccgcuguauuaggcgccauugacuucaaagguaccguuuucgggguggcuucccaacggaacacuacaggaggcucagucggcgccacccgugcacacgaggugcacaucgauacgaccaauccucgcuauacaccaaagcuggggagcguccucauguacagugaaucugacgauuuugacgauggacagcccacuagauucaccccgauugguaugggcgccgacgauuggcaucagugggagcuuccugaguacuccgggcaccugacauugaacaugaaucuagcuccagcgguggcacccgccuuuccuggagaaaggauccuguucuuucggagcguugugcccucggcuggcgguuaugggucuggccagaucgacugccucauuccacaagaguggguacagcauuucuaccaggaagccgcaccuucccagucagccgucgcucugauacgauaugugaaccccgauacuggacgcaauaucuuugaggccaaacuucacagagaaggcuucauuaccguugcaaacagugggaauaacccaaucguggucccgccuaauggauacuuuagguucgaggcgugggugaaccaauuuuauacacugacccccauggguacuggccaggggcggcgcagaguacaguga

SEQ ID NO: 19401 - RNA, 1623 nt, Artificial Sequence
  derived and/or modified sequence opt3 from capsid_protein__Norovirus__AGC66788
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcuccgccuucgugguucagccucagaaugguagauguacuaccgacggcguguugcuggggacaacucaacuaucaccagucaacauuugcaccuuuaggggagaugugacacauaucgcaggcagucggaauuacaccaugaaccucgcuagccugaauuggaacaauuaugacccgacggaagagauucccgccccucuugguacuccagauuucguagggaagauccagggaguucugacacagaccacuaagggcgacggcucuacacgcgggcacaaggcuaccguguacacgggauccgcccccuuuaccccuaaauuggguucaguccgauucagcacagacacugaaaacgauuuugagacccaucagaauacaaaguucacuccagugggcgucauccaagacgggggaaccacacacagaaacgaaccccagcagugggugcucccgaauuacaguggcucugauguuccuaacgugcaccuggcaccagccguagcucccaauuuuccuggugagcaauuacuguucuuuagguccaccaugcccggguguagcggcuauccaaacauggaccucgauugccuucugccucaggaguggguccagcauuucuaccaggaagcggcacccgcccaaucggacguggcuuugcuacgguuuguuaacccagauacuggacgugugcuguucgaguguaaacuccacaagucuggcuaugucacgguggcccauacagggcagcacgaccugguaauuccgccuaauggauacuuucgcuucgauuccugggugaaccaguucuauacccuugcacccauggguaauggcacugggagaaggcgggcccuguga

SEQ ID NO: 19402 - RNA, 1629 nt, Artificial Sequence
  derived and/or modified sequence opt3 from capsid_protein__Norovirus__AGL96587
augaagauggccagcaacgacgcugcacccuccaaugauggcgccgcgucucuggugccugaggggaucaacgaaaccaugccacucgagccggucgcuggagccucaauugcagcccccguugcuggucagacaaauauaaucgacccuuggauuagaacuaacuucgugcaagcaccaaauggcgaauuuacgguaagucccaggaacagcccuggggagauccuucugaauuuggaauuaggaccagaucugaaccccuaccuagcccaccucccucggauguauaauggcuacgcuggugggguggagguccaggugcugcuugccggaaacgcguucaccgcaggcaaaauucuguuugccgcuaucccaccgaauuuccccguugacaugauauccccugcccagaucacaauguugccacaucucauuguggauguccgcacucuggagcccaucaugauuccucugccagacgugcgaaacguauuuuaucacuucaauaaccagccccaaccgcguaugagacucguugcaauguuauacaccccucugaggucuaauggcucgggggaugacgugcuuacagucucaugccggguguugacccgccccacuccagauuuugaguucaucuaucuggugccucccagcgucgaaaguaagacaaaaccauuuacccuacccauacucacgauuuccgaacugacuaacucuagauucccuaucccaauugagcagcuuuacaccgcuccgaacgagacaaauguugugcagugucagaacggaaggugcacucuggacggugaauugcaaggcaccacacagcuccugagcuccgccguauguucauaucgggggcgcaccguggcgaauaacggagauaauugggaccagaacuuacugcagcucacguaccccaauggcgccaguuacgauccuacugacgaggucccagcaccccuugguacacaagacuuuagcgggaugcuguauggaguguugacccaggauaacguuaaugugucuacuggcgaagcuaagaacgccaaaggcaucuacaucuccacaaccucagggaaguucacgccuaagauuggaagcauaggucuacauaguaucaccgagcacguccauccaaaucagcaaucucgauuuacacccgugggcguagcuguuaacgaaaauacuccguuccagcagugggugcugccucacuaugccggguccaccagaagccacacaaaccucggaacugcacuggccccaaccuuccccggcgagcagcuucuguuuuucaggucgcgggucccuugcgugcaagguuugcaggggcaggacgcuuuuauugauugucuccugccccaggagugggucaaucauuucuaccaagaagcggcaccaucucaggccgacguggcuuuaauccguuauguuaacccugauacaggccgcacccuguuugaggccaaacuacacagauccggauucauaacugugucacauacgggcgcauacccccucguagucccaccgaacgggcacuuuagguucgacaguugggugaaucaguuuuauagccuggccccuaugggaacagguaacggccggcgacgcauucaguga

SEQ ID NO: 19403 - RNA, 1623 nt, Artificial Sequence
  derived and/or modified sequence opt3 from capsid_protein__Norovirus__AGQ57036
augaagauggccagcaacgacgcugcacccuccaaugauggcgccgcggggcuggugccugagaucaacaaugaagucaugccacucgagccgguugcuggagccucucuugcaacccccgugguaggucagcaaaacauuauagacccuuggaucagaaauaacuucgugcaggccccagcuggcgaauuuacagucucacccaggaauaguccuggggagauucuguuggauuuagaacugggaccagagcuaaaccccuaccucgcacaccuggcccggauguauaauggccaugcuggugggauggaggugcagaucguucuugccggaaacgcguucacugcaggcaaaauuaucuuugccgcuauaccuccaggcuucccguacgaaaaucugagccccucccagaucacgaugugcccucacgugauuaucgacguccgccaauuggagccagugcuccugcccaugccugauauucgaaacaacuuuuuccauuauaaucaggggaaugacccaaagcugcgucucguagccauguuauacacaccccugagagcaaacaacucuggagaugacguuuuuaccgugucguguaggguccuuacuaaaccgucaccugauuucgaauuuaccuucuuggugcccccaacaguggagagcaagaccaaacaguuuacucugccuauccuaaagauaagugagaugacaaauucccgguuccccgucccaguugaaaugauguauaccgcucgcaacgagaaucaggugguacaaccccagaacgguagagugacgcucgacggcgaacugcuugggacuaccccucuguuggccgucaauauuugcaaguuuaaaggagaggugaucgcgaagaacggcgauguuaggucuuaccggauggacauggaaauuacaaauacugaugguaccccaaucgacccgacagaggacacccccgggccuaucggaagcccagauuuccagggcauucucuucggcguggccucccagcgcaacaaaaaugagcaaaaccccgcaacgcgagcucacgaagccgacauaaauacugggggagaucaguaugcuccuaagcuggcccaggucaaauuuuucucagagagucaagacuuugaagugcaucagccaacaguauucacccccguugguguggcaggcgaugccagccacccguuuagacagugggucuuaccuagguacgggggacaccugacuaacaauacacaucucgcuccagcgguggcaccccuuuucccuggcgagcagauccuguuuuuccggucucaaauucccuccucaggugggcacgaauugggcuacauggacugucuagucccacaggagugggugcagcauuuuuaucaggaggccgcuaccgcccaaagcgaaguugcacugauccguuucauaaacccugauacgggacgcgugcucuuugaggccaagcugcacaagcagggcuucauuaccguagcucacacaggggacaaucccaucgucaugccaccgaacggauacuuuagauucgaagccugggugaaccaguucuauagucuugcaccuguugguacuggcaaugggaggcggcgaauccaguga

SEQ ID NO: 19404 - RNA, 1623 nt, Artificial Sequence
  derived and/or modified sequence opt3 from capsid_protein__Norovirus__AGT95926
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcagcacuacccacaggaaugagccccaacaguggguauugccgaguuacucugggcggaacacacacaauguccaucucgccccugcuguggcgccaaccuuucccggagaacagcuguuauucuuucguuccacuaugccuggcuguagcgguuaucccaacauggaccuggauugccuccuuccacaggaguggguucaauacuucuaucaggaggcagccccugcucagucggacguggcccuguugcgcuuugucaaucccgauacggggagagugcuauucgaauguaagcugcacaaaucuggcuacguaacaguggcacauaccggacagcacgaccucguuauuccaccgaacggcuauuuuagguucgauuccugggucaaccaauucuacacucuggccccuauggggaauggaaccggucggcgacgcgugguguga

SEQ ID NO: 19405 - RNA, 1623 nt, Artificial Sequence
  derived and/or modified sequence opt3 from capsid_protein__Norovirus__AGT95927
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaccccucuggagaaacuuuucacgggaccuuccucagccuucgucgugcagccacagaacgguagauguacuaccgauggcguauugcuggggacaacucaacuaaguccgguuaauaucugcaccuuuaggggagacgugacacauauuaccggcagccggaacuacacgaugaaucucgcaucucagaacuggaauaacuaugaucccacugaggaaaucccugcuccacuggguacacccgacuucgucgggaagauacagggagugcuuacccagacuacacgcaccgacggcuccacgcgaggccacaaggccaccgucuacacagggucagcugauuuugccccuaagcugggaagagugcaauucgagacugacaccgaucaugacuuugaaguuaaucagaacacaaaauucacuccaguggguguaauucaggauggcgggaccacacacaggaaugagccccaacagugggucuugccgagcuacaguggacggaacacccacaaugugcaucucgcacccgccguugcuccaacuuuucccggcgaacagcuguuauucuuucguucuacgaugccugguuguuccggguaucccaacauggaccuggauugccuccuuccacaggagugggugcaauacuucuaucaggaggcggccccugcacagagcgacgucgcucuguugcgcuuugugaaucccgauacaggcagaguacuauucgaauguaagcugcacaaaucgggauacgugaccguugcccauacuggccagcacgaccucgucaucccaccgaacggguauuuuagguucgauucuugggugaaccaauucuacacccuggcaccuaugggaaaugguacaggccggcgacgcguggucuga

SEQ ID NO: 19406 - RNA, 1623 nt, Artificial Sequence
  derived and/or modified sequence opt3 from capsid_protein__Norovirus__AGT95928
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuagcauuugcacuuuuaggggagacgugacccauaucacaggcucucggaauuacaccaugaaccucgcaucccagaauuggaacaauuaugaucccacggaggaaauaccugcuccacuggguacucccgacuucgucgggaagauucagggaaugcuuacacagaccacucgcgccgacggcucaacacgaggccacaaggcuaccguguacacggggagcgccgauuuugcaccuaagcugggaagaguccaauucgagaccgacacagaucaugacuuugaagccaaccagaauacuaaauucaccccaguggguguuauccaggauggcaguacaacucacaggaacgagccccaacaguggguguugccgucuuacuccgggcggaauacccacaacguacaucucgcuccugcggucgcaccaacauuucccggagaacagcuguuauucuuucguagcaccaugccuggcuguucggguuaucccaauauggaccuggauugccuccuuccacaggagugggugcaauacuucuaucaggaggccgcuccugcccagucugacguugcacuguugcgcuuugugaaccccgauacugggagaguccuauucgaauguaagcugcacaaauccggcuacgugacgguagcccauacaggacagcacgaccucgugauuccaccgaauggcuauuuuagguucgauucauggguuaaccaauucuacacccuggcuccuauggggaacggaacuggucggcgacgcgucguguga

SEQ ID NO: 19407 - RNA, 1623 nt, Artificial Sequence
  derived and/or modified sequence opt3 from capsid_protein__Norovirus__AGT95929
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaagcaaaucagaacaccaaauucacaccaguuggugugauccaggauggcagcacuacccacaggaaugagccccaacaguggguauugccgaguuacucugggcggaacacacacaauguccaucucgccccugcuguggcgccaaccuuucccggagaacagcuguuauucuuucguuccacuaugccuggcuguagcgguuaucccaacauggaccuggauugccuccuuccacaggaguggguucaauacuucuaucaggaggcagccccugcucagucggacguggcccuguugcgcuuugucaaucccgauacggggagagugcuauucgaauguaagcugcacaaaucuggcuacguaacaguggcacauaccggacagcacgaccucguuauuccaccgaacggcuauuuuagguucgauuccugggucaaccaauucuacacucuggccccuauggggaauggaaccggucggaagcgagugguguga

SEQ ID NO: 19408 - RNA, 1623 nt, Artificial Sequence
  derived and/or modified sequence opt3 from capsid_protein__Norovirus__AGT95930
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucaacagauuuugcuccuaagcugggaagagugcaauucgagacugacaccgaucaugacuuugaagccaaucagaacacaaaauucacuccaguuggugugauccaggauggcagcaccacacacaggaaugagccccaacaguggguauugccgaguuacucugggcggaacacccacaauguccaucucgccccugcaguggcuccaacuuuucccggagaacagcuguuauucuuucguuccacgaugccuggcuguagcgguuaucccaacauggaccuggauugccuccuuccacaggaguggguucaauacuucuaucaggaggcggccccugcacagucggacguggcucuguugcgcuuugucaaucccgauacagggagagugcuauucgaauguaagcugcacaaaucuggcuacguaaccguggcccauacuggacagcacgaccucguuauuccaccgaacggcuauuuuagguucgauuccugggucaaccaauucuacacccuggcaccuauggggaauggaacaggucggcgacgcgccguguga

SEQ ID NO: 19409 - RNA, 1623 nt, Artificial Sequence
  derived and/or modified sequence opt3 from capsid_protein__Norovirus__AGT95931
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacuggaauaacuaugaucccacggaggaaauaccugcuccacuggguacucccgacuucgucgggaagauucagggagugcuuacacagaccacucgcacagacggcuccacccgaggccacaaggccacggucuacaccgggucagcugauuuugccccuaagcugggaagagugcaauucgagacagacacugaucaugacuuugaaaccaaucagaacacaaaauucacuccaguuggugugauccaggauggcagcaccacacacaggaaugagccccaacaguggguauugccgaguuacucugggcggaacacccacaauguccaucucgccccugcaguggcuccaacuuuucccggagaacagcuguuauucuuucguuccacgaugccuggcuguagcgguuaucccaacauggaccuggauugccuccuuccacaggaguggguucaauacuucuaucaggaggcggccccugcacagucggacguggcucuguugcgcuuugucaaucccgauacagggagagugcuauucgaauguaagcugcacaaaucuggcuacguaaccguggcccauacuggacagcacgaccucguuauuccaccgaacggcuauuuuagguucgauuccugggucaaccaauucuacacccuggcaccuauggggaauggaacaggucggcgacgcgccguguga

SEQ ID NO: 19410 - RNA, 1623 nt, Artificial Sequence
  derived and/or modified sequence opt3 from capsid_protein__Norovirus__AHC12655
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuagcacugugaguugcagaguacugaccaggccguccccugauuucgacuuuauuuuccucgugcccccaacagucgaaucucggaccaaaccuuuuagcgugcccguuuuaacuguggaggaaaugacaaauucccgcuucccaaucccccuggagaaacuuuuuaccggaccuucaagugccuucgucgugcagccacagaacgguagauguacgacugauggcguauugcuggggaccacacaacuaagcccgguuaauauuugcacuuucaggggagacgugacccauaucacaggcucucggaacuacaccaugaaucucgcaucccagaacuggaauaacuaugaucccacggaggaaauaccugcuccacuggguacucccgacuuugucgggaagauucagggaaugcuuacacagaccacucgcacagacggcucaacccgaggccacaaggccacgguguacaccgggagcgcugauuucgccccuaagcugggaagaguccaauuugagacagacacugaucaugacuucgaagcaaaucagaacaccaaauuuacaccaaucggugugauucaggauggcaguacuacccacaggaaugagccccaacaguggguuuugccgucuuacuccgggcggaacacacacaaugugcaucucgccccugcuguagcgccaaccuuccccggagaacagcuguuauuuuuccguagcacuaugccuggcuguucggguuaucccaacauggaccuggauugccuccuuccacaggaguggguccaauacuuuuaucaggaggcagccccugcucagucugacguggcccuguugcgcuucguuaaucccgauacggggagagugcuauuugaauguaagcugcacaaauccggcuacgucacaguggcacauaccggacagcacgaccucguaaucccaccgaacggcuauuucagguuugauucaugggugaaccaauucuacacucuggccccuauggggaauggaaccggucggcgacgcguugucuga

SEQ ID NO: 19411 - RNA, 1623 nt, Artificial Sequence
  derived and/or modified sequence opt3 from capsid_protein__Norovirus__AHC12658
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaauuccuccaaauuuuccgacugagggccucucucccucgcagguaacgauguucccucauaucguuguggacguccgccaacuggagccagugcuuauaccccugccugaugugcgaaacaauuuuuaucacuacaaccagucaaaugacccaaccaucaaguugauugcuaugcucuauacaccccugcgugccaacaacgccgggggagaugucuucacuguuagcugcagagugcugaccaggccgaguccugacuuugauuucaucuuucucguacccccaacaguggaaucccggaccaaaccuuucucuguccccguguuaacuguugaggaaaugacaaauagccgcuuuccaauuccccuggagaaacuuuucaccgguccuuccucagcguucgugguccagccacagaacggcagauguacgacugacgggguguugcugggaaccacacaacuaaguccgguaaauaucugcacuuuuaggggcgauguuacccauauaacagguagccggaacuacaccaugaaucucgcaucucagaacuggaauaacuaugaccccacggaggaaauuccugcuccacuggggacucccgauuucgugggaaagauccagggcaugcuuacacagaccacucgcacagacggcuccacccgagggcacaaggccacggucuacaccggaucagcugacuuugccccuaagcuggguagagugcaauucgagacagauacugaccaugauuuugaagcaaaucagauuaccaaauucacaccaaucggcgucauccaggacgggagcacuacccacaggaacgagccccaacaguggguguugccgaguuacucuggacggaauacacacaacguucaucucgccccugcuguggcgccaaccuuucccggcgaacagcuguuauucuuucguuccacuaugccugguuguagcggguaucccaauauggaucuggacugccuccuuccacaggaguggguacaauacuucuaucaggaggcagccccugcucagucggaugucgcccuguugcgcuuugugaaccccgacacgggcagaguucuauucgaauguaagcugcacaaaucuggauacgugacagucgcacauaccggccagcacgaucucgugauuccaccgaauggguauuuuagguucgacuccuggguaaaccaauucuacacucuggccccuaugggaaacgguaccggccggcgacgcgugguuuga

SEQ ID NO: 19412 - RNA, 1632 nt, Artificial Sequence
  derived and/or modified sequence opt3 from capsid_protein__Norovirus__AHW99832
augaugauggccagcaaggacgcucccuccucugcagauggcgccaacggggcgggacagcuggugccugaggucaauaacgcugaaccacucccgcuugaccccguugccggugcaucaaccgcccuggcuacagcaggccaagugaauaugaucgauccuuggauuuucaacaauuuuguacaggccccacagggggaguucacuauaagucccaacaauacgccuggagacaucuuguuugauuuacagcugggcccacaccuaaaccccuuccucgcucaucugagccaaauguacaaugguuggguggggaacaugagagucagggugauucuugccggaaaugcguuuaccgcaggcaaaguuaucauuugcugugugccuccaggcuuccagucccggacacugucuaucgcccaggcuacuuuguuuccgcacauaaucgccgacguccgcacccucgaacccauugagaucccucuggaagaugugcgaaacacacuguaucauaccaaugacaaccagccaacuaugcgucucuuaugcaugcuguacacaccccuuagaaccgggggagguucgggcgggacggaugcauucguaguugcuggaaggguguugacuuguccuucaagcgacuuuaauuuccuguuucuagucccacccaccguggagcaaaagacacggccguucagugugccuaacauuccccuccagcugcuuuccaacucucgcgucccaaaucugauccagagcaugguuuuguccccugaucaggcccaaaacgugcaguuucagaauggcagaugcacuaccgacggucaacuccuggggacaacccccguaucagugagucagauauuaaaauucaggggaaaggucagcgcgggcucuaaagugauuaaccugacggagcucgauggcuccccauuccuugccuuugaagcacccgcuccuacuggguucccagaccugggaacaucagacuggcacguugagaugagcuugaauaguaacucucaguccagcgguaauccgauccuacugcgggauauucaucccaacucgucugaauuugugccucaccucggcuccgucugugugaccgccgcuaucgagguagccggggacuauacuggaacaauccaguggaccucacaaccaaguaauguuacgcccgugccugaugucaacuucuggaccauuccacacuacggcagcaaucuggcagaggccucccagcuugcucccguggucuauccgccugguuuuggggaagcgauaguguacuucaugucuccaauccccggcccuaacacagcacauaagcccaaucugguuccaugcuugcucccucaggaguuugugacucacuucguaagcgaacaggcccccucaaugggagaggcugcccugguccauuauguggacccagauaccaaccgcaauuuaggcgaauuuaagcuguacccggagggguucauuacauguguuccuaacggaacugguccccaacagcuaccacucaacggcguguuugucuucgcaaguugggugucccgauuuuaccagcugaaacccguagggaccgccagcucugcuagaggaaggcuuggcgugcggcguuga

SEQ ID NO: 19413 - RNA, 1647 nt, Artificial Sequence
  derived and/or modified sequence opt3 from capsid_protein__Norovirus__AHZ12735
augaagauggccagcaacgacgcuacccccuccaaugauggcgcagccgggcuggugccugagaucaacaaugaagcgauggcucucgagccagucgccggagcagccauugcugcaccgcuuacaggucagcaaaacauaaucgaccccuggauuaugaauaacuucguucaggccccuggcggggaauuuacugugucuccaagaaauucacccggagagguacuguugaacuuagaacugggccaggagaucaauccuuaccuagcucaccucgccaggauguauaacgguuacgcagggggauucgaggugcaggucgugcuggcgggcaaugccuuuacggcuggcaaaauuaucuucgccgcaauaccacccaacuuuccuaucgauaaucuuagugcugcccaaauuaccaugugcccacauguuaucguggacguccggcagcuggaaccggugaacuugcccaugccugauguacgcaauaacuucuuucacuauaaccaggggagcgacucccgacuccgucugguugcgaugcuguacacaccacucagagccaauaacucuggagaugacguguucacugucucguguaggguguuaacccggcccucaccugaguuuagcuucaauuuucuggugccacccacagucgaaaguaagaccaaaccguucacucuuccuauuuugacaaucuccgagaugucuaacagccgcuuucccguuccaauagauucccugcauaccucaccuacggagaauauugugguacagugccaaaacgguagagugacucuagacggcgaacucauggggaccacacagcugcuucccagucagaucugugcauucaggggaguccugacucggagcaccucucgcacauccgaucaggcugacaccgccacgccacgauuguucaauuauuacuggcacauucaacucgauaaccugaauggcacucccuaugacccugcugaggacaucccagguccguuagggacacccgauuuuagaggaaagguguucggcguugccucacagaggaacccugacagcaccacucgggcacaugaagccaaaguggauacaaccgcuggccguuuuacgccaaagcuggggagucucgagaucucuaccgaauccggagacuucgaucagaaucaacccacacgcuuuacuccugucgguauuggcguggacagagaggcggauuuccagcaguggagccuuccagacuacucggggcaguuuacccacaacaugaaucuggcacccgccguagcuccgaacuucccuggagagcaauugcuauuuuucaggucucagcugccauccucaggcggucggaguaaugggauacucgauugccugguuccccaggaaugggugcagcacuuuuaccaagagagcgccccugcacagacacaggucgcccuugugcgauaugucaaccccgacacuggccgcgugcuguucgaagcuaaguugcauaaacucggauuuaugaccaucgccaagaacggcgauuccccaauuacaguuccucccaauggguacuucagauucgagucuugggugaacccauuuuauacccuggcaccgaugggaacugguaauggcaggcggcgcguacaguga

SEQ ID NO: 19414 - RNA, 1647 nt, Artificial Sequence
  derived and/or modified sequence opt3 from capsid_protein__Norovirus__AHZ12736
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugguugcgaugcuguacacaccccucagagccaauaacucuggagacgauguguucacugucucguguaggguguuaacccggccuucaccagaauuuagcuucaauuuucuggugcccccgacagucgagaguaagaccaaaccuuucacucuucccauuuugacaaucuccgaaaugucuaacagccgcuuuccaguuccuauagacucccugcauaccucacccacggagaauauugugguacagugccagaacgguagagugacucuagauggcgagcucauggggaccacacaacugcuuccaagucagaucugugcauucaggggaguccugacucggagcaccucucgcgcuuccgaccaggccgauacagcuacgccccgauuguucaauuauuacuggcacauucagcucgacaaccugaauggcaccccuuaugacccagccgaagauaucccgggucccuuagggacuccugacuuuagaggaaagguguucggcguugcaucacaaaggaacccagauaauacaacccgggcccaugaggcuaaaguggacacuacagcgggccguuuuacccccaagcuggggagccucgaaaucaguacggagucuggagauuucgaccagaaccagccuacccgcuuuacaccagucgguauuggcguggaucacgaagcagacuuccaacaguggucccuucccgauuacagcgggcaguuuacucacaauaugaaccuggccccggcuguagccccuaauuucccaggagagcaguugcuauuuuucagaucgcaacugcccucuuccggcgguaggucaaacgggauacucgacugccugguuccucaggagugggugcagcauuuuuaccaggaaagugcacccgcccaaacccaggucgcucuugugcgguaugucaacccagauacaggccgagugcuguucgaggccaaguugcacaaacucggauuuaugacuaucgcaaagaauggcgacagcccuauuaccguucccccaaacggguacuuccgcuucgaauccugggugaauccguuuuauacacuggcgccuaugggaaccgguaacggcagaaggcggguacaguga

SEQ ID NO: 19415 - RNA, 1647 nt, Artificial Sequence
  derived and/or modified sequence opt3 from capsid_protein__Norovirus__AHZ12737
augaagauggccagcaacgacgcugcacccuccaaugauggcgccgcggggcuggugccugagaucaacucugaagcuauggcccucgagccagucgcaggagccgcuauugcagccccgcuuaccggucagcaaaauauaaucgaccccuggauuaugaacaauuucguucaggcuccuggcggggaauuuacagugucaccaagaaacagucccggagagguacuguugaauuuagaacugggcccugagaucaacccauaccuagcccaccucgcgaggauguauaaugguuacgcagggggauucgaggugcaggucgugcuggccggcaacgcuuuuacugccggcaaaauuaucuucgcagcuauacccccuaauuuuccaaucgauaaccuuagcgccgcgcagauuacgaugugcccgcauguuaucguggacguccggcaacuggaacccgugaauuugccuaugccagauguacgcaacaauuucuuucacuauaaccagggguccgacucucgacuccgucugauugccaugcuguacacaccccucagagcaaacaauucgggagaugacguuuucaccgugucauguagggucuuaacucggccuagcccagauuuuaguuucaacuuucuggugcccccgaccguggaguccaagacaaaaccuuucucucuucccaucuugaccauaagcgaaauguccaauucacgcuuuccagucccuauugacagucugcauacuagccccacagagaacaucguugugcagugccagaaugguagaguaacccuagauggcgagcucauggggacgacucaacugcuuccaucucagauuugugcuuucaggggaacccugacacgguccacuucacgcgccagcgaccaggcugauaccgccacaccccgauuguucaacuauuacuggcacauccagcucgacaaucugaacggcaccccuuaugacccagcagaagauaucccgggucccuuagggacgccugacuuuagaggaaagguguucggcgucgccagucaaaggaauccagaugcuacuacacgggcgcaugaggcaaaaauugacaccacuucuggccguuuuacacccaagcuggggucccucgaaauaagcaccgagucggaugacuucgaucagaaccagccuacgcgcuuuaccccagugggaguugguguggaccacgaacccgauuuccaacaguggguccuuccggacuacgccggccaguuuacacacaauaugaaccuggcuccugccguggcaccaaauuuccccggggagcaguugcuauuuuucagaucucaacugccuuccucaggaggcaggaguaacgguauccucgauugccugguaccccaggaguggguucagcauuuuuaccaggaaagcgccccaucccaaacucagguggcucuuguccgguaugugaauccugacaccgggcgaguccuguucgaggccaaguugcacaaacucggcuuuaugacaauugcaaagucuggagacagccccaucacugugccaccgaacggcuacuuccgcuucgaaucauggguuaacccuuuuuauacccuggcgcccauggggacaggaaaugguagaaggcggauacaguga

SEQ ID NO: 19416 - RNA, 1647 nt, Artificial Sequence
  derived and/or modified sequence opt3 from capsid_protein__Norovirus__AHZ12738
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugguugcgaugcuguacacaccccucagagccaauaacucuggagacgauguguucacugucucguguaggguguuaacccggccuucaccagaauuuagcuucaauuuucuggugcccccgacagucgagaguaagaccaaaccuuucacucuucccauuuugacaaucuccgaaaugucuaacagccgcuuuccaguuccuauagacucccugcauaccucacccacggagaauauugugguacagugccagaacgguagagugacucuagauggcgagcucauggggaccacacaacugcuuccaagucagaucugugcauucaggggaguccugacucggagcaccucucgcgcuuccgaccaggccgauacagcuacgccccgauuguucaauuauuacuggcacauucagcucgacaaccugaauggcaccccuuaugacccagccgaagauaucccgggucccuuagggacuccugacuuuagaggaaagguguucggcguugcaucacaaaggaacccagauagcacaacccgggcccaugaggcuaaaguggacacuacagcgggccguuuuacccccaagcuggggagucucgaaaucucuacggaguccggagauuucgaccagaaucagccuacccgcuuuacaccagucgguauuggcguggaucacgaagcagacuuccaacaguggagccuucccgauuacucggggcaguuuacucacaacaugaaucuggccccggcuguagccccuaacuucccaggagagcaguugcuauuuuucagaucucaacugcccuccucaggcgguaggaguaaugggauacucgacugccugguuccucaggagugggugcagcauuuuuaccaggaaagcgcacccgcccaaacccaggucgcucuugugcgguaugucaacccagauacaggccgagugcuguucgaggccaaguugcacaaacucggauuuaugacuaucgcaaagaacggcgacuccccuauuaccguucccccaaauggguacuuccgcuucgaaucuugggugaacccguuuuauacacuggcgccuaugggaaccgguaauggcagaaggcggguacaguga

SEQ ID NO: 19417 - RNA, 1647 nt, Artificial Sequence
  derived and/or modified sequence opt3 from capsid_protein__Norovirus__AHZ12739
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuaacuuuccaaucgacaaucuuagugcugcccagauuaccaugugcccgcauguuaucguggauguccggcaacuggagcccgugaacuugccuaugccagacguacgcaauaacuucuuucacuauaaccaggggagcgauucccgacuccgucugguugcgaugcuguacacaccccucagagccaauaacucuggagacgauguguucacugucucguguaggguguuaacccggccuucaccagaauuuagcuucaauuuucuggugcccccgacagucgagaguaagaccaaaccuuucacucuucccauuuugacaaucuccgaaaugucuaacagccgcuuuccaguuccuauagacucccugcauaccucacccacggagaauauugugguacagugccagaacgguagagugacucuagauggcgagcucauggggaccacacaacugcuuccaagucagaucugugcauucaggggaguccugacucggagcaccucucgcacauccgaccaggcugauaccgccacgccccgauuguucaauuauuacuggcacauucagcucgacaaccugaauggcacuccuuaugacccagcugaagauaucccgggucccuuagggacaccugacuuuagaggaaagguguucggcguugccucacaaaggaacccagauagcaccacucgggcacaugaggccaaaguggacacaaccgcuggccguuuuacgcccaagcuggggagucucgaaaucucuaccgaguccggagauuucgaccagaaucagccuacacgcuuuacuccagucgguauuggcguggaucacgaagcggacuuccaacaguggagccuucccgauuacucggggcaguuuacccacaacaugaaucuggcaccggccguagcuccuaacuucccaggagagcaguugcuauuuuucagaucucaacugcccuccucaggcgguaggaguaaugggauacucgacugccugguuccucaggagugggugcagcauuuuuaccaggaaagcgcccccgcacaaacacaggucgcccuugugcgguaugucaacccagauacuggccgagugcuguucgaggcuaaguugcacaaacucggauuuaugaccaucgccaagaacggcgacuccccuauuacaguucccccaaauggguacuuccgcuucgaaucuugggugaacccguuuuauacccuggcaccuaugggaacugguaauggcagaaggcggguacaguga

SEQ ID NO: 19418 - RNA, 1623 nt, Artificial Sequence
  derived and/or modified sequence opt3 from capsid_protein__Norovirus__AHZ12912
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucagcgugccugucuuaacaguggaggaaaugaccaauucccgcuuucccaucccacuggagaaacuuuucacgggacccucaagugcguucguugugcagccucagaacgguagauguacuaccgauggcgucuugcuggggacaacucaacuaagcccagugucuauaugcaccuuuaggggagacguaacacauauuccgggcucccacaauuacaccaugaaccucgccucacagaauuggaacagcuaugaucccacggaggaaaucccugcaccacuggguacucccgacuucguugggaagauucagggagugcuuacacagaccacucggacaaauggcaguacccgcggccauaaggcuacggucuacaccgggucugccgacuuuuccccuaagcugggacgagugcaauucgcuacagauacuaacaaugacuuugagaccaaccagaauacaaaauucacuccagucggugugauccaggauggcagcaccacacccagaaacgaaccgcaacaguggguuuugccuucguacucugggaggaauauccacaacgugcaccucgccccagcaguagcccccaccuuuccuggagagcagcuguuauucuuucgguccacuaugcccggcuguucagguuauccaaauauggaccuggauugccuccuuccucaggaauggguccaauacuucuaucaggaggcugcgcccgcacagagugacguggcccuguugcguuuuguuaacccagauacggggcgcgugcuauucgaguguaagcugcauaaaagcggcuacgucacaguggcucacaccggacagcaugaccucguaauuccgccuaacggcuauuuuagauucgauuccugggugaaucaauucuacacucuggcccccauggggaacggaaccgguaggcggcgagcacuuuga

SEQ ID NO: 19419 - RNA, 1623 nt, Artificial Sequence; identical to SEQ ID NO: 19418
  derived and/or modified sequence opt3 from capsid_protein__Norovirus__AHZ12913

SEQ ID NO: 19420 - RNA, 1623 nt, Artificial Sequence
  derived and/or modified sequence opt3 from capsid_protein__Norovirus__AHZ12998
augaagauggccagcuccgacgcuaaccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaugacguguucaccgucagcugcagaguucugacaaggccgaguccugauuuugacuucauuuuucucgugcccccaaccguagaaucccggacuaaaccuuucucugugcccgucuuaacaguggaggaaaugaccaauagccgcuuuccaaucccccuggagaaacuuuucacgggaccuuccucagcguucguugugcagccacagaacgguagauguacuaccgauggcgucuugcuggggacaacucaacuaaguccggugaauauaugcaccuuuaggggagacguaauucauaucagcggcucucggaacuacacaaugaaucucgccucccagaacuggaacucauaugaucccaccgaggaaauuccugcaccacuggguacgcccgacuucguugggaagauccagggagugcuuacucagacaacccgcacuaauggcagcacacgaggccacaaggcuaccgucuacacggggagugccgacuuuucuccuaagcugggaagagugcaauucgcuaccgauacagacaaugauuuugagacuaaccagaauaccaaauucacaccagucggugugauccaggacggcuccacuacccccaggaacgaaccgcaacaguggguuuugccuagcuacucggggcggaauauucauaacgugcaccucgccccagcaguagcccccacauuuccuggagagcagcuguuauucuuucguucuaccaugcccggcuguuccgguuauccaaauauggaucuggacugccuccuuccucaggaauggguccaauacuucuaucaggaggcugcgcccgcacagucagauguggcccuguugcgcuuuguuaacccagacacugggagagugcuauucgaguguaagcugcacaaaaguggcuacgucacgguggcucauacaggacagcacgaucucguaauaccgccuaacggcuauuuuagguucgacagcugggugaaucaauucuacacccuggcccccauggggaacggaacuggucggcgacgcgcacuuuga

SEQ ID NO: 19421 - RNA, 1623 nt, Artificial Sequence; identical to SEQ ID NO: 19420
  derived and/or modified sequence opt3 from capsid_protein__Norovirus__AHZ13001

SEQ ID NO: 19422 - RNA, 1623 nt, Artificial Sequence; identical to SEQ ID NO: 19420
  derived and/or modified sequence opt3 from capsid_protein__Norovirus__AHZ13004

SEQ ID NO: 19423 - RNA, 1623 nt, Artificial Sequence; identical to SEQ ID NO: 19420
  derived and/or modified sequence opt3 from capsid_protein__Norovirus__AHZ13010

SEQ ID NO: 19424 - RNA, 1623 nt, Artificial Sequence; identical to SEQ ID NO: 19420
  derived and/or modified sequence opt3 from capsid_protein__Norovirus__AHZ13015

SEQ ID NO: 19425 - RNA, 1623 nt, Artificial Sequence; identical to SEQ ID NO: 19420
  derived and/or modified sequence opt3 from capsid_protein__Norovirus__AHZ13020

SEQ ID NO: 19426 - RNA, 1623 nt, Artificial Sequence; identical to SEQ ID NO: 19420
  derived and/or modified sequence opt3 from capsid_protein__Norovirus__AHZ13023

SEQ ID NO: 19427 - RNA, 1545 nt, Artificial Sequence
  derived and/or modified sequence opt3 from capsid_protein__Norovirus__AIC32559
auggcccuggagcccguggucggcgcugcaaucgccgcgccuguugcugggcagcaaaacgugauugacccauggauaagaaauaacuucguacaggccccgggaggugaauuuaccgugagccccaggaaugcaccuggcgagauccucugguccgccccacuugggcccgaucugaacccuuacuugucucacuuagcucggauguauaauggauacgcaggcgguuucgaaguccaggugauucuggccgggaacgcuuuuacagccggaaagguuaucuucgcggcagugccacccaauuuuccuacugagggccuaucaccaagucaggucacgauguucccgcauauugugguagacguucgccaacucgaacccgugcugaucccucuuccagauguccgaaacaauuuuuaucacuacaaccagagcaaugaccccaccauaaaacugaucgccauguuguauacaccucuccgugcuaacaaugccggcgaugacguguucacuguguccugcagaguccugaccaggccaucucccgauuuugacuucauuuuucugguuccgccuacaguggagucgcggaccaagcccuucucaguaccagugcucacugucgaggaaaugacaaacagccgcuuuccuauccccuuagagaaacuguucaccgggccaaguuccgcauucgugguucagccccagaauggaagauguacgacugauggugugcuuuugggcaccacacaacugucuccugucaacauuugcacuuuuaggggagacgugacccauaucacagggagccggaacuacaccaugaaucuagcuucccagaacuggaauaacuaugauccaacggaagagauaccggcgccccucggcgccccugacuucguagguaagauucaggggaugcugacucagacaacccgcgccgauggaucaacucgaggccacaaagcaacaguuuacaccggcagugcugacuuugccccaaaacuugggagagugcaauucgagacggacaccgaucaugacuuugaagcuaaucagaacacaaaguucacucccgucggagugauccaggaugguagcaccacacacaggaaugagccucaacaguggguccugccaucuuacuccggccggaacacucacaaugugcauuuggcccccgcaguugccccgaccuuuccuggggaacagcuccuguucuuucguucaacaaugccaggauguagcggcuaucccaacauggacuuagauugccugcucccucaggagugggugcaauacuucuaucaggaagcugcgcccgcacagagugacguagcccuucugcgcuuugucaauccagauaccgguagaguguuguucgaguguaagcuacacaagucuggguacguuacuguggcucauacgggccagcacgaccuggucauuccucccaacggauauuuuagguucgauuccugggugaaucaauucuacacacucgccccaaugggcaacggggcaggacggcgacgcguaguguga

SEQ ID NO: 19428 - RNA, 1617 nt, Artificial Sequence
  derived and/or modified sequence opt3 from capsid_protein__Norovirus__AID51474
auggccagcaacgacgcuacccccuccaaugauggcgcagccgggcuggugccugagucuaacaaugaagcgauggcucucgagccagucguuggagccucacuugcagccccggugacaggucagacuaacaucauugaccccuggauaagaacgaauuucguacaagcuccuaacggcgaauuuaccgugaguccaaggaauagccccggggagauccuggucaacuuggaauuaggaccugagcugaauccauaccuagcacaccucgcccggauguauaacggcuacgcuggugggauggaggugcagguuaugcuggccggaaaugcguucacagcaggcaagauuaucuuugccgcugugcccccuuauuucccagucgaaaaccuuuccccgucucagauuacuauguuuccccaugugaucauagauguacgcacccuggagccuguuuugcucccaaugcccgacgugcgaucgacacuguuccacuuuaaucagaaagaugaaccuaagaugcgucuggucgccaugcucuacaccccauuaagaucaaacggcagcggggacgauguguucacugugaguugcaggauccugacacggcccuccccggaguuugacuucaccuaucuugucccucccacgguugagucuaaaacuaagccauuuaccuugccugugcugacacuaggagaacucagcaauucccgcuucccccugucaauugaugagaugguaacuagcccaaacgaaagcaucgugguccaaccccagaacgguagagugacccuugacggcgagcuguuggggacaacccagcuccaggcauguaauauuugcucuaucaggggaaaaguuacgggccaagugccuaacgaacagcauauguggaaucuggagauaacuaacuuaaaugguacacaguuugauccaaccgacgaugucccggcuccccugggggugccugacuucgccggagagguauucggcguucucucccagcggaaccgcggcgaaucaaauccagcgaaccgagcccacgacgcaguggucgcuacuuacagcgauaaguauacacccaaacuugggcuggugcaaauuggaaccuggaauacgaacgacgucgagaaucagccuaccaaguuuacaccaaucgguuugaacgaaguggccaauggccauagauucgagcaguggacucuacccagguacaguggggcucugacccucaacaugaaucuggccccggcaguugccccucuuuuuccaggagaacggcuguuguucuuucguucuuacgugccccucaagggcgguuucgggaacccugcuauugauugucugguaccccaagaguggguccagcacuuuuaucaggaguccgcgccaaguuuaggcgacguggcacugguucgcuacgugaacccugauacaggaagaguccuauucgaagccaaacuccacaagggcggguuucugacugugucgucuaccuccacaggacccguagugguuccagcuaaugguuauuucagguuugacucaugggucaaccaguucuacagucuugccccgaugggcaccgggaauggacggcgacgcuuucaauga

SEQ ID NO: 19429 - RNA, 1617 nt, Artificial Sequence; identical to SEQ ID NO: 19428
  derived and/or modified sequence opt3 from capsid_protein__Norovirus__AID51477

SEQ ID NO: 19430 - RNA, 1617 nt, Artificial Sequence; identical to SEQ ID NO: 19428
  derived and/or modified sequence opt3 from capsid_protein__Norovirus__AID51480

SEQ ID NO: 19431 - RNA, 1617 nt, Artificial Sequence; identical to SEQ ID NO: 19428
  derived and/or modified sequence opt3 from capsid_protein__Norovirus__AID51483

SEQ ID NO: 19432 - RNA, 1617 nt, Artificial Sequence; identical to SEQ ID NO: 19428
  derived and/or modified sequence opt3 from capsid_protein__Norovirus__AID51486

SEQ ID NO: 19433 - RNA, 1617 nt, Artificial Sequence; identical to SEQ ID NO: 19428
  derived and/or modified sequence opt3 from capsid_protein__Norovirus__AID51489

SEQ ID NO: 19434 - RNA, 1617 nt, Artificial Sequence; identical to SEQ ID NO: 19428
  derived and/or modified sequence opt3 from capsid_protein__Norovirus__AID51492

SEQ ID NO: 19435 - RNA, 1617 nt, Artificial Sequence; identical to SEQ ID NO: 19428
  derived and/or modified sequence opt3 from capsid_protein__Norovirus__AID51495

SEQ ID NO: 19436 - RNA, 1623 nt, Artificial Sequence
  derived and/or modified sequence opt3 from capsid_protein__Norovirus__AIE40036
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaugacguguucacugucagcugcagaguucugaccaggcccaguccggauuuugacuucauuuuucucgugccucccacaguagaaucccggaccaaaccauucucugugccugucuuaacuaucgaggaaaugacaaacagccgcuuucccauaccacuggagaaacuuuucaccggacccuccucagccuucgugguucagccucagaaugguagauguacgacugauggcguguugcuggggaccacacaacuaaguccagucaacauuugcacuuuuaggggagacgugacccauaucacaggcagccggaauuacaccaugaaccucgcaucucagaauuggaacaauuaugauccgacggaggaaauucccgcuccucuggguacuccagacuucguagggaagauccagggaaugcuuacacagaccacucgcacagacggcuccacccgaggccacaaggccacgguuuacaccgggucagcugauuuugcccccaagcugggaagagugcaauucgagacagacacugaucaugacuuugaagcaaaccagaauaccaaauucacaccuaucggugucauucaggauggcagcacuacccacaggaacgagccacaacaguggguguugcccaguuacucugggcggaauacacacaacguccaucucgccccggcuguggcgccuaccuuuccaggagaacagcuguuauucuuucguuccacuaugcccggcuguagcgguuauccuaauauggaccuggauugccuccuuccccaggaguggguucaauacuucuaucaggaggcagccccagcucagucggacguggcccuguugcgcuuuguaaacccugauacggggagaguccuauucgaauguaagcugcacaaaucuggcuacgugacaguugcacauaccggacagcacgaccucgugauacccccaaacggcuauuuuagguucgauuccugggucaaucaauucuacacucuggccccgauggggaacggaaccggucggcgacgcgcucuuuga

SEQ ID NO: 19437 - RNA, 1647 nt, Artificial Sequence
  derived and/or modified sequence opt3 from capsid_protein__Norovirus__AJW87644
augaagauggccagcaacgacgcugcacccuccaaugauggcgccgcggggcuggugccugagaucaacaaugaagcuauggcccucgagccagucgcaggagccgcuauugcagccccgcuuaccggucagcaaaacauaaucgaccccuggauuaugaauaacuucguucaggcuccuggcggggaauuuacagugucuccaagaaauucacccggagagguacuguugaacuuagaacugggcccugagaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgauaaucuuagugccgcgcagauuacgaugugcccgcauguuaucguggacguccggcaacuggaacccgugaacuugccuaugccagauguacgcaauaacuucuuucacuauaaccaggggagcgacucccgacuccgucugauugccaugcuguacacuccccucagagcaaauaacucuggagaugacguuuucacagugucguguagggucuuaacucggccuucaccagauuuuagcuucaauuuucuggugcccccgaccguggagaguaagacaaaaccuuucucccuucccaucuugaccauaucugaaaugagcaacucccgcuuuccagucccuauugacucacugcauaccagucccacagagaauaucguugugcagugccagaacgguagaguaacccuagauggcgagcucauggggacgacucaacugcuuccaagccagauuugugcuuucaggggagugcugauccggucuaccucccgcgccucagaccaggcugauacagccacuccccgauuguucaauuauuacuggcacauccagcucgacaaccugaauggcaccccuuaugacccagcagaagauauuccgggucccuuagggacaccugacuuuagaggaaaggucuucggcguggccagccaaaggaacccagauaccacgacucgggcucaugaggcgaaaauagacacaaccaguggccguuuuacucccaagcuggggucucucgaaaucuccacagagagcgaugacuucgaucagaauaagccuacccgcuuuacgccaguuggaauugguguggaccacgaagcagauuuccagcaauggacccuucccgacuacgccggccaguuuacacacaacaugaaucuggcuccggccgucgcaccuaacuucccaggggagcaguugcuauuuuucagaucgcagcugcccucuuccggaggcaggucaaaugguauccucgauugccuggugccucaagaguggguacagcauuuuuaccaggaaagugcccccagccagucccaaguugcucuugugcgguauauaaacccagacacugggcgaguccuguucgaggccaaauugcacaagcucggcuuuauuaccaucgcgaaaaacggagacucuccuaucacagugcccccaaauggcuacuuccgcuucgaaagcugggucaacccguuuuauacucuggcaccuauggggaccggaaaugguagaaggcggauucaguga

SEQ ID NO: 19438 - RNA, 1623 nt, Artificial Sequence
  derived and/or modified sequence opt3 from capsid_protein__Norovirus__ALG05457
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugaguccagaucuaaaccccuaccucgcccaccugagccggauguauaauggcuacgcuggugggguggagguccaggugcuucuggccggaaacgcguucaccgcaggcaaaaucuuguuugccgcuguuccuccaaauuucccgguggaguuucucucccccgcccagauuacaaugcugccucaucugaucgucgacgugcgcacucucgaaccaauaaugauccccuuaccugauguacgaaacaccuucuuucacuauucuaaucagccaaacucgcguaugagacugguugcaaugcuuuacacacccuugaggucaaacggcagcggggacgauguguucaccgucaguugccgggugcugacucgcccgacaccugacuuugaguucaccuaucuagugcccccauccgucgaaucuaagacgaaaccuuuuagccuccccauucugacucuuuccgagcugaccaauucaagauucccaguucccaucgauaguuuguuuacagcucaaaacaaugugcuccagguacagugucagaacggaaggugcacucuggacggugaguuacaaggcaccacacagcugcucccuagcgggauuugugccuuccggggacgcgugaccgcgcagaucaaucagcgagauagauggcauaugcaacuucagaaccugaauggcacgacuuacgacccaacagaugacgucccggcccccuuggguaccccugacuucaagggggugguuuuuggaauggugucucagaggaacgucggcaaugaugcaccaggcuccacucgggcucaacaggccugggugucaacauauagcccccaguucguaccuaaacuagggaguguuaaccugcguauaucugacaaugaugacuuucaguuccaaccaaccaaguuuacgcccgugggagucaacgaugacgaugacggucacccguuccgccagugggaacucccuaauuacuccggcgagcugacccuuaacaugaaucuggcuccacccguggccccuaacuuucccggggaacagcucuuguucuuuaggagcuucgucccaugcucgggaggcuacaaccaggguauuaucgauugucugauuccucaagaguggauccagcauuuuuaucaggaaucugcacccucccagucagacguggccuuaaucagauacguuaauccagauacagggcggacucuguucgaggcuaagcuacaccgaaguggcuauauuaccguggcgcacagcggagacuacccgcucguagucccugcaaacggccauuuucgcuucgacuccugggugaaucaauucuauucucuggcccccauggggacaggaaacgguagaaggcgggcucaguga

SEQ ID NO: 19439 - RNA, 1623 nt, Artificial Sequence
  derived and/or modified sequence opt3 from capsid_protein__Norovirus__ALG05460
augaagauggccagcaacgacgcugcacccuccaaugauggcgccgcggggcuggugccugagggaaacgacgaaacccucccacuugagccggucgcuggugccgcaaucgccgcucccguuacaggccagaauaacauuauagauccuuggaucagaacuaauuucgugcaagcaccaaacggggaauuuacgguaucucccaggaacucaccuggagagauucuguugaauuuagaacugggcccagaccuaaaucccuaccucgcccaccugagucggauguauaacgguuacgcugggggaguggagguccaggugcuucuggccggcaaugcguucaccgcaggcaaaaucuuguuugccgcuguuccuccaaacuucccgguggaguuucucagccccgcccagauuacaaugcugccucaucugaucgucgaugugcgcacucucgaaccaauaaugauccccuuaccugacguacgaaauaccuucuuucacugcuccaaccagccaaauucucguaugagacugguugcaaugcuuuauacacccuugaggucgaacgggucaggagaugacguguucaccgucagcugucgggugcugacucgcccgacaccugauuuugaguucaccuaccuagugcccccaagugucgaauccaagacgaaaccuuuuucucuccccauucugacucuuagcgagcugaccaacuccagauucccaguucccaucgacucauuguuuacagcucaaaauaacgugcuccagguacagugccagaaugguagguguacucuggauggcgaguuacaagggaccacacagcugcucccuaguggaauuugcgccuuccggggccgcgugaccgcgcagaucaaccagcgagacagauggcauaugcaacuucagaaucugaacgguacgacuuaugauccaacagacgacgucccggcccccuuggggaccccugauuucaagggagugguuuuuggcauggugagccagaggaaugucggcaacgacgcaccagggucuacucgggcucaacaggccuggguguccacauacucaccccaguucguaccuaaacuaggaagcguuaaucugcguauaagugauaacgacgauuuucaguuccaaccaacccaguuuacgcccgugggugucaaugacgaugacgauggccacccguuccgccagugggaacucccuaacuauucuggggagcugacccuuaauaugaaccuggcuccacccguggccccuaauuuucccggagaacagcucuuguucuuuagauccuucgucccauguagcggcgguuacaaccaagggauuaucgacugccugauuccucaggaguggauccagcauuuuuaccaggaaucggcacccucucaauccgauguggccuuaaucagguauguuaacccagacacaggccggacucuguucgaggcuaagcuacaccgaucaggauacauuaccguggcgcacaguggcgacuauccgcucguagucccugcaaaugggcauuuucgcuucgauagcugggugaaccaguucuacucccuggcccccaugggaacagguaauggcagaaggcgggcucaguga

SEQ ID NO: 19440 - RNA, 1623 nt, Artificial Sequence
  derived and/or modified sequence opt3 from capsid_protein__Norovirus__ALL73873
augaagauggccagcaacgacgcugcacccuccaaugauggcgccgcggggcuggugccugagggaaacaaugaaacccucccacuugagccggucgcuggugccgcaaucgccgcucccguuacaggccagaacaauauuauagacccuuggaucagaacuaacuucgugcaagcaccaaauggggaauuuacgguaucucccaggaacucaccuggagagauucuguugaauuuagaacugggcccagaucuaaaccccuaccucgcccaccugagucggauguauaaugguuacgcugggggaguggagguccaggugcuucuggccggcaacgcguucaccgcaggcaaaaucuuguuugccgcuguuccuccaaauuucccgguggaguuucucagccccgcccagauuacaaugcugccucaucugaucgucgacgugcgcacucucgaaccaauaaugauccccuuaccugauguacgaaacaccuucuuucacuauuccaaucagccaaacucucguaugagacugguugcaaugcuuuacacacccuugaggucgaacgggucaggagacgauguguucaccgucagcugccgggugcugacucgcccgacaccugacuuugaguucaccuaucuagugcccccaagugucgaauccaagacgaaaccuuuuucucuccccauucugacucuuagcgagcugaccaauuccagauucccaguucccaucgauucauuguuuacagcucaaaacaaugugcuccagguacagugucagaacgguaggugcacucuggacggcgaguuacaagggaccacacagcugcucccuaguggaauuugugccuuccggggccgcgugaccgcgcagaucaaucagcgagauagauggcauaugcaacuucagaaccugaaugguacgacuuacgacccaacagaugacgucccggcccccuuggggaccccugacuucaagggagugguuuuuggcauggugagccagaggaacgucggcucugaugcaccaggguccacucgggcucaacaggccugggugucaacauauagcccccaguucguaccuaaacuaggaaguguuaaucugcguauaucugacaacgaugacuuucaguuccaaccaaccaaguuuacgcccgugggugucaaugaugacgaugacggccacccguuccgccagugggaacucccuaacuacuccggggagcugacccuuaauaugaaccuggcuccacccguggccccuaauuuucccggagaacagcucuuguucuuuaggagcuucgucccaugcucgggcgguuacaaccaggggauuaucgauugucugauuccucaagaguggauccagcauuuuuaucaggaaucugcacccucccagucagacguggccuuaaucagauacguuaacccagauacaggccggacucuguucgaggcuaagcuacaccgaaguggauauauuaccguggcgcacagcggcgacuacccgcucguagucccugcaaaugggcauuuucgcuucgacuccugggugaaccaauucuauucucuggcccccaugggaacagguaauggcagaaggcgggcucaguga

SEQ ID NO: 19441 - RNA, 1623 nt, Artificial Sequence; identical to SEQ ID NO: 18640
  derived and/or modified sequence opt3 from capsid_protein__Norovirus__ALL73876

SEQ ID NO: 19442 - RNA, 1623 nt, Artificial Sequence
  derived and/or modified sequence opt3 from capsid_protein__Norovirus__ALL73879
augaagauggccagcaacgacgcugcacccuccaaugauggcgccgcggggcuggugccugagggaaacaaugaaacccucccacuugagccggucgcuggugccgcaaucgccgcuucuguuacaggccagaacaauauuauagaccccuggaucagaacuaacuucgugcaagcaccuaauggggaauuuacgguaucaccaaggaacagucccggagagauucuguugaauuuagaacugggcccugaucuaaacccauaccucgcccaccugagccggauguauaaugguuacgcugggggaguggagguccaggugcuucuggccggcaacgcguucaccgcaggcaaaaucuuguuugccgcuguucccccuaauuucccaguggaguuucucuccccggcccagauuacaaugcugccccaucugaucgucgacgugcgcacucucgaaccuauaaugaucccauuacccgauguacgaaacaccuucuuucacuauucuaaucagccuaacucgcguaugagacugguugcaaugcuuuacacaccauugaggucaaacgggagcggagacgauguguucaccgucaguugccgggugcugacucgccccacaccggacuuugaguucaccuaucuagugccucccuccgucgaaucuaagacgaaaccauuuagccucccuauucugacucuuuccgagcugaccaauucaagauuccccguuccaaucgauaguuuguuuacagcucaaaacaaugugcuccagguacagugucagaacgguaggugcacucuggacggcgaguuacaagggaccacacagcugcuccccagcggaauuugugccuuccggggccgcgugaccgcgcagaucaaucagcgagauagauggcauaugcaacuucagaaccugaaugguacgacuuacgacccuacagaugacgucccagccccguuggggacccccgacuucaagggagugguuuuuggcauggugucucagaggaacgucggcaaugaugcaccuggguccacucgggcucaacaggccugggugucaacauauagcccacaguucguacccaaacuaggaaguguuaaccugcguauaucugacaaugaugacuuucaguuccaaccuaccaaguuuacgccagugggugucaacgaugacgaugacggccaccccuuccgccagugggaacucccgaauuacuccggggagcugacccuuaacaugaaucuggcuccuccaguggcccccaacuuuccuggagaacagcucuuguucuuuaggagcuucguccccugcucgggcgguuacaaccaggggauuaucgauugucugauuccacaagaguggauccagcauuuuuaucaggaaucugcaccuucccagucagacguggccuuaaucagauacguuaaucccgauacaggccggacucuguucgaggcuaagcuacaccgaaguggauauauuaccguggcgcacagcggcgacuacccacucguagucccggcaaacgggcauuuucgcuucgacuccugggugaaucaauucuauucucuggccccuaugggaacagguaacggcagaaggcgggcucaguga

SEQ ID NO: 19443 - RNA, 1623 nt, Artificial Sequence; identical to SEQ ID NO: 18640
  derived and/or modified sequence opt3 from capsid_protein__Norovirus__ALL73882

SEQ ID NO: 19444 - RNA, 1623 nt, Artificial Sequence; identical to SEQ ID NO: 18640
  derived and/or modified sequence opt3 from capsid_protein__Norovirus__ALL73888

SEQ ID NO: 19445 - RNA, 1623 nt, Artificial Sequence
  derived and/or modified sequence opt3 from capsid_protein__Norovirus__ALQ43927
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccacaacuacaccaugaaucucgcaucucagaacugguccaauuaugaucccacggaggaaauaccugcuccacuggguacucccgacuucgucgggaagauucagggagugcuuacacagaccacucggacagacggcucaacccgcggccauaaggccacggucuacaccgggagcgcugauuuugccccuaagcugggacgagugcaauucgagacagacacugaucacgacuuugaagcaaaccagaauaccaaauucacaccaguuggugugauccaggauggcgggacuacccacagaaacgagccccaacaguggguauugccgaguuacucuggaaggaauacaccuaacguccaucucgccccagcuguggcgcccaccuuuccuggcgaacagcuguuauucuuucgguccacuaugcccgguuguagcggguauccaaauauggaccuggauugccuccuuccucaggaguggguucaauacuucuaucaggaggcagcccccgcucagucggacguggcccuguugcguuuugucaacccagauacgggccgcgugcuauucgaauguaagcugcacaaaucuggauacguaacaguggcacauaccggccagcacgaccucguuauuccgccuaauggguauuuuagauucgauuccugggucaaccaauucuacacucuggcccccaugggaaacgguaccggcaggcggcgaccacuuuga

SEQ ID NO: 19446 - RNA, 1623 nt, Artificial Sequence
  derived and/or modified sequence opt3 from capsid_protein__Norovirus__ALQ43928
augaagauggccagcuccgacgcuaaccccucugauggcucagcagccaaucuggugccugaggucaacaaugaaguuauggcgcucgagccagugguaggggcugccaucgcagccccgguggcuggacagcaaaacgucauugaccccuggauaagaaauaacuucgugcaggcaccugguggcgaauuuaccguuaguccaaggaaugcccccggggagauccuuuggagcgcuccucugggaccagauuugaaccccuacuuaucccaccuggcccggauguauaauggcuacgcggguggguucgaagugcaggucauucuagcaggaaacgccuuuacagcuggcaaagugaucuucgccgcaguaccuccaaauuuuccgacugagggccucucucccucgcagguuacgauguucccucauauuguggucgacgugcgccaacuggagccagugcuuaucccccugccugauguccgaaacaauuuuuaucacuacaaccagucaaaugacccaaccauaaaguugaucgcuaugcucuauacaccccugcgugccaacaacgcgggggaugacguuuucacugugagcugcagaguacugaccaggccgaguccugauuuugacuucauuuuucucgugcccccaacagucgaaucccggaccaaaccuuucucugugcccguuuuaacuguggaggaaaugacaaauagccgcuuuccaaucccccuggagaaacuuuucaccggaccuuccucagccuucgucgugcagccacagaacgguagauguacgacugauggcguauugcuggggaccacacaacuaaguccgguuaauauuugcacuuuuaggggagacgugacccauaucacaggcagccggaacuacaccaugaaucucgcaucucagaacugguccaauuaugaucccacggaggaaauaccugcuccacuggguacucccgacuucgucgggaagauucagggaaugcuuacacagaccacucgcacagacggcucaacccgaggccacaaggccacgguguacaccgggagcgcugauuuugccccuaagcugggaagaguccaauucgagacagacacugaucaugacuuugaagcaaaccagaauaccaaauucacaccaguggguguuauccaggauggcaguacuacccacaggaacgagccccaacaguggguguugccgucuuacuccgggcggaauacaccuaacguacaccucgccccagcugucgcgcccaccuuuccuggagaacagcuguuauucuuucguagcacuaugcccggcuguucggguuauccaaauauggaccuggauugccuccuuccucaggagugggugcaauacuucuaucaggaggcagcccccgcucagucugacguugcccuguugcgcuuugugaacccagauacggggagaguccuauucgaauguaagcugcauaaauccggcuacgugacaguagcacacaccggacagcaugaccucgugauuccgccuaauggcuauuuuagguucgauucauggguuaaccaauucuacacucuggcccccauggggaacggaaccggucggcgacgcccacuuuga

SEQ ID NO: 19447 - RNA, 1623 nt, Artificial Sequence; identical to SEQ ID NO: 17999
  derived and/or modified sequence opt3 from capsid_protein__Norovirus__ALQ44123

SEQ ID NO: 19448 - RNA, 1623 nt, Artificial Sequence; identical to SEQ ID NO: 18640
  derived and/or modified sequence opt3 from capsid_protein__Norovirus__ALQ44124

SEQ ID NO: 19449 - RNA, 1623 nt, Artificial Sequence; identical to SEQ ID NO: 18640
  derived and/or modified sequence opt3 from capsid_protein__Norovirus__ALQ44125

SEQ ID NO: 19450 - RNA, 1644 nt, Artificial Sequence
  derived and/or modified sequence opt3 from capsid_protein__Norovirus__BAB83514
augaagauggccagcuccgacgcugcacccucuaccgauggcucagccgggcuggugccugaggucaacaaugaaacaauggcgcucgagccaguugugggagcuccgcuugccgcacccguagccggucagcacaacaucauugacccuuggauaaaaaugaauuucgugcaagcuccaaacggcgaauuuacugucagucccagaaaugcaccuggggagauccuguuggauuuagaacugggaccagaccuaaaccccuaccucagccaucuggccaggauguauaauggcuacgcuggugggauggaggugcagguugugcuugccggaaacgcguucacggcaggcaagauuaucuuugccgcugucccuccaaauuucccggccgagaaccuguccgcagcucaggugaccaugugcccccacguaauuguugaugugcggcaguuggaaccugucaugcucccaaugcccgacauccgcaauaaacuguuucauuauaaccaaguggaugacccuaagcugcgacucuuagccuaccuguauacaccacuucgugcgaauaacgccggcgaugacguguucacugucucuuguagaguuuugaccaggcccacaccggauuuugaguucauguuucuggugccucccaccguagaaucgaaaacuaagccauucucacuaccuagccucacacuggacgagcuuaguaauucccgguuucccgcaccaauagugcagcuguacaccaacccccacgauaacuuggucgugcagccucagaaugggcgcugcacgaucgacggacuccugcaagguacuacccaguuaguuucuuguaacgugugcagcuucagaggcacaauuggggacggacagccagcuucccauucagaggaagagaucaugccgauggccuuuaauauucagagggaaaucaugcuggagaaccucgauggcacucccuaugacccugcugaugacauaccagccguccuugguagucccgauuuccaaggggugauuuucggaauccugagccagcggaauaccgacggccagacacgcgcacacgaagccaagguagauacccgagcugcgagauuugcaccuaaauugggcuucguuguggccacggucgagucuacugacuuucacgcuaaccaaccauccagguucacacccguggggcuaggaggugauaauaaccaggacuuuaaucaguggcggcugccggccuacggcggggcacucaccaacaauacuaaccuggccccuccagucaugcccguguacccuggagagcagcuucuguucuuucguucacaauugcccagcaguggcgguguuguagggggcuggcucgauugucuguuaccacaggaaugggugcagcauuucuuucaggagucugcuacaucccaaagcgacgucgcccuggugcgcuauauuaauccuaccacgggaagaguucuauucgaagcaaagcuccacaaacagggcuuucugaccguggcggcuucggggucuuacccccuugucgugccagccgacggauauuucagguuugaguccuggguaaaccaguucuacacauuggcaccgauggguaauggcucagggcggcgacgcgccagauga

SEQ ID NO: 19451 - RNA, 1644 nt, Artificial Sequence
  derived and/or modified sequence opt3 from capsid_protein__Norovirus__BAB83516
augaagauggccagcuccgacgcucccccuucuaccgauggcucagcagggcuggugccagaggucaacaaugaaacaauggcccucgagccgguugugggagcgccccuugcugccccuguagcaggucagcacaacaucauugacccauggauaaaaaugaauuucgugcaagcccccaacggcgaauuuacugucaguccuagaaaugcuccaggggagauccuguuggauuuagaacugggacccgaccuaaacccuuaccucagccaucuggcaaggauguauaauggcuacgccggugggauggaggugcagguugugcuugcuggaaacgccuucacggcgggcaagauuaucuuugcagccgucccaccgaauuuccccgcugagaaccuguccgccgcacaggugaccaugugcccucacguaauuguugaugugcggcaguuggaaccagucaugcuccccaugccugacauccgcaauaaacuguuucauuauaaccaaguggaugacccaaagcugcgacucuuagcuuaccuguauacaccccuucgugccaauaacgcgggcgaugacguguucacugucucuuguagaguuuugaccaggccgacaccugauuuugaguucauguuucuggugcccccaaccguagaaucgaaaacuaagccuuucucacuacccgggcucacacuggacgagcuuagcaauagucgguuuccagcccccauagugcagcuguacaccaacccucacgauaacuugaucguccagccacagaauggacgcugcacgauugacggucuccugcaaggcacuacccaguuaguguccuguaacguuugcucuuucagagggacaaugggagagggccagccggcagcucauagcgaagacgagaucaugcccauggccuuuaaugugcagagggaaauuaugcuggagaaccucgaugguuccccuuaugacccaacugaugacauccccgcuguccuugggucaccugauuuccaaggagugauguucggcauacugagucagcggaauaccgacggccagacacgcgcccacgaagcaaagguagauacccgagccgcuagauuugcgccaaaauugggguucguuguggcaacggucgagagcacugacuuucacgccaaccaacccucuagguucacaccggugggacuagguggcgauaccaaucgggacuuuaaccaguggcagcugccugcuuacgggggagcccucacuaauaacacaaaucuggcaccacccgucaugccuguguaccccggcgagcagcuucuguucuuucguucccaauugccaucaagcggugggguuguggccggcuggcucgauugucuguuaccucaggaauggguacagcauuucuuucaggagagugcuaccucucaauccgacgucgcccuggugcgcuauguuaaccccacgaccggaagagugcuauucgaagcaaagcuccacaaacagggcuuucugacagucgcggcuagcgggucguacccacuugugguaccggccgacggauauuucagguuugagucuugggugaaucaguucuacacuuuggcaccuauggguaacggcuccgggcggcgacgcgccagauga

SEQ ID NO: 19452 - RNA, 1629 nt, Artificial Sequence
  derived and/or modified sequence opt3 from capsid_protein__Norovirus__BAD72797
augaagauggccagcaacgacgcugcacccuccaccgauggcgccgcggggcuggugccugagucuaauaacgaagucauggcucucgagccaguugccggagcagcccuugcugcaccggugacaggucagacuaauaucauugaccccuggauaagagccaacuucguacaagcuccuaauggcgaauuuacggugucaccaaggaacgcccccggggagguccuguugaguuuagaacugggaccugagcuaaauccauaccucgcgcaccuggcacggauguauaacggcuacgccggugggauggaggugcagguuaugcuugcuggaaaugccuucaccgcaggcaaacugguguuugcugccgugcccccucauuucccagucgaaaacuugagcccgcagcagaucacaauguuuccccacguaauuaucgauguucgcacucucgagccugugcugcugccacuccccgacguccgaaauaacuucuuucauuauaaucaaaaggaugacccuaaaaugcguauuguggcgauguuauacaccccacugagauccaacggcucuggggaugacguguucacagucucgugcaggguucuuacccggcccucaccggauuuugacuucacuuauuuggugccucccacaguagaaagcaagaccaaaccauuuacgcugccuauccuaacucucggagagcugaguaauucccgcuuccccgugucuauagaucagauguacaccagcccaaacgaggucaucuccgugcagugucagaacgguagaugcacacuugacggcgaacugcaagggacuacccaguugcagguuucaggaauuugugccuuuaagggcgaggugacagcacaccuccaugauaaugaccaccuguauaacgucaccaucacgaauuuaaacggucccccuuucgacccaagugaagauauuccggcuccccugggggugccugacuuccagggaaggguauuuggcguuaucagccaacgggauaagcagaaugccgcuggccacucugagccagccaaccgcgggcaugacgcagugguccccacuuacacagcccaguacaccccuaaacucggacaagugcagauagguacuuggcagacagaugaccuucaggucaaucaaccagugaaguucacccccguuggccugaacgauacggaacacuuuaaucagugggugguaccgcgauaugcuggggcguugaaccuaaauaccaaccuggcaccuuccgucgccccaguguuccccggagagagacuccuguuuuucaggucauacauuccucuuaaaggcgguuaugggaaucccgcuaucgacugccuguugccacaggaguggguucagcauuuuuaccaagaagccgcaccuagcaugagugagguggcccucguccgguauauuaaccccgauacaggccgugcucuguucgaagccaaguuacaccgcgcaggauuugugacuguaucuuccaauaccagcgcgccagugguugucccggcuaacggcuacuucagauuugacucgugggugaaccaguucuauucucuggccccuaugggggcaggaaaugguaggcggcgagugcaguga

SEQ ID NO: 19453 - RNA, 1647 nt, Artificial Sequence
  derived and/or modified sequence opt3 from capsid_protein__Norovirus__BAD72798
augaagauggccagcaacgacgcugcacccuccaaugauggcgccgcggggcuggugccugagaucaacaaugaagcuauggcccucgacccagucgcaggagccgcuauugcagccccgcuuaccggucagcaaaacauaaucgaucccuggauuaugaauaacuucguucaggcuccuggcggggaguuuacagugucuccaagaaauucacccggagaaguacuguugaacuuagagcugggcccugaaaucaauccauaccuagcccaccucgcgaggauguauaacgguuacgcagggggauucgaggugcaggucgugcuggccggcaaugcuuuuacugccggcaaaauuaucuucgcagcuauacccccuaacuuuccaaucgacaaucuuagugccgcgcagauuacgaugugcccgcauguuaucguggauguccggcaacuggagcccgugaacuugccuaugccagacguacgcaauaacuucuuuuauuacaaccaggggagcgauucccgacuccgucugauugccaugcuguauacaccccucagagcaaauaacucuggagacgauguuuucaccgugucguguagggucuuaacucggccuucaccagacuuuagcuucaauuuucuggugcccccgaccguggaaaguaagacaaaaccuuucacccuucccaucuugacuauauccgagaugucuaacagccgcuuuccagucccuauugaaucccugcacacaucacccaccgagaauaucguugugcagugccagaacgguagaguaacgcuagauggcgagcucauggggacuacccaacugcuuccaagucagauuugugcuuucaggggagugcugacacggagcacuucucgcgccuccgaccaggcugauaccgccacaccccgauuguucaauuacuauuggcauguccagcucgacaaccugaauggcaccccuuacgacccagcagaagauaucccgggucccuuagggacgccugacuuuagaggaaagguguucggcguugccucacaaaggaacccagauagcacuacacgggcucacgaggcgaaaguggacaccacugcaggccguuuuacacccaagcuggggagucucgaaaucucuaccgaguccagcgauuucgaccagaaucagccuacgcgcuuuaccccagucggaauugguguggauaacgaagccgacuuccaacaguggucgcuucccgauuacucuggccaguuuacacauaauaugaaccuggcuccggccguagcaccuaauuucccaggggagcaguugcuauuuuucagaucccaacugcccucaaguggaggcaggagcaacgguguucucgacugccuggugccucaggaguggguccagcacuuuuaucaggaauccgcccccgcucaaacucagguggcccuuguccgguacgugaacccagauaccgggcgaguucuguucggcgcaaaguugcacaaacucggauuuaugacaauagcgaagaauggcgacucuccuaucacugugcccccaaacggguauuuccgcuucgagagcuggguaaauccguuuuacacccuggcuccuaugggaacagguaacggcagaaggcggauucaguga

SEQ ID NO: 19454 - RNA, 1647 nt, Artificial Sequence
  derived and/or modified sequence opt3 from capsid_protein__Norovirus__BAD72799
augaagauggccagcaacgacgcugcacccuccaaugauggcgccgcggggcuggugccugagucuaacaaugaagucauggcucucgagccaguugccggagcaucacuugccgcuccggugaccggucagacaaacaucauugaccccuggauaagaaugaauuucguacaagcaccuaacggcgaauuuacugugaguccaaggaauagccccggggagguccuguugaacuuagaacugggaccugagcuaaauccauaccucgcccaccugucccggauguauaacggcuacgcuggugggauggaggugcagaucaugcuugccggaaaugcguucacggcaggcaaacugauuuuugccgcuguucccccucauuucccaaucgaaaacuugucuccgccccagauuaccauguuuccucacgugaucauagauguccgcacacucgagccagugcugcugcccaugccugacauccgaaauucguucuuucauuucauucagcgugaugaaccaaagaugagacucguagccauguuauauacuccccugaggucaaacggcagcggggacgauguuuuuaccgugaguugccggguccuuacacgcccgaccccugacuucgauuuuacuuacuuggugcccccaacaguggaguccaaaucuaagccuuucacccugcccauccuaacgcucggagagcugacuaauagcagauuuccacuucccauugacguccuguauaccaacccuaacgaauccgcaaucguucaaugucagaaugguaggugcacauugggcggggagcuccagggaacugcucagcuguuaccaaccggcauaugugccuuccgggguaaagugacacaacagguacaggaugaacaccgcgggacccauuggaacaugacggugacuaagcugaauggaacaccguucgaccccaccgaggaugucccugcgccacucggcacucccgacuuuucaggccagauuuacggggugaucagucaacgaaacacaaauaccguuccuggagaagguaaccuuccagccaauagagcacacgaggcugugauugccacguauagccccaaguucaccccgaaacugggcaacauccaguuuucuacaugggagacucaggacgucuccucagggcaaccuaccaaguucacaccagugggauuggcuagcguagaugccaauagucacuuugaccaguggacucuacccucuuacuccggcgcacugacccucaacaugaaucuggccccuagcguugcucccguguucccaggugaaugccuucuguuuuucaggucguuuaucccuuugaaagggggcuacggaaaccccgcgauugauugucucaugccacaggaguggguccagcaucuguaucaagaaucugcaccguccuuaucagacguggcccugguccgguacgugaauccugagacaggccguacccuauucgaagcuaagcuccaccgcaacggguuucugacuguugccagaaauagugcaggacccgugguagccccaacgaacgguuauuucagguuugauagcugggucaaccaguucuacacacuugcucccaugggcaauggguccggacggcgacgcauacaguga

SEQ ID NO: 19455 - RNA, 1623 nt, Artificial Sequence
  derived and/or modified sequence opt3 from capsid_protein__Norovirus__BAD72800
augaagauggccagcaacgacgcugcacccuccaaugauggcgccgcggggcuggugccugaggucaacaaugaaaccauggcucucgagccaguugccggagcaucuaucgccgcuccgcuuacaggucagaacaaugugauugaccccuggauaagacugaacuucguacaagcaccuaauggcgaauuuacugugucaccaaggaacagucccggggagaucuuguuaaaucuggaacuaggaccugagcucaacccauaccuggcccaccuugcucggauguauaauggcuacgccgguggggucgaggugcagguucuguuggcgggaaacgcauucacggccggcaaacucguguuugcugccauucccccucauuucccagucgauaaucugagcccgggccagaucaccauguuuccccacgugauuaucgacguacgcacacuggaaccuguucucuuaccacugcccgaugugcgaaacaauuucuuucauuauaaccagcaauccgaccagcguaugagacuuauagcaauguuguacacuccucugaggucuaacgggucgggagaugacgucuucaccgugucaugccgggugcuaacacgcccaagccccgauuuucacuuccauuaucucgucccgccuaccguugagaguaagacuaaacccuuuuccgugccaguacugacacuuaaugaacugaccaacucuagauucccugugcccaucgacgcuauguacacgagcccaaaugauuccauugucgugcagccccagaacgguagggccacuaucgacggcgaguugcucgggaccacacaacugauuccuucaggaaucuguaguuuucggggcaagauaacuacccacuuagcggaugaccgccaccuguggaauauucagguuagcaaccucaaugguacaccauucgacccgaccgaugacgugcccgccccucuugggaugccagauuucucuggacagaucuuuggcgucguguccgagcgagacacgggcacuaaccccgcaaauagagcucaugaugccguacuggcuacauauucagccaaauacaccccuaaguuggggagcguucagauuggaacuugggacacagaagaucuacuggagaggcaaccagugaaguucacccccgucggucucaacgaaaucggccaggacaaacacuuugaucagugggugcugccgaauuacaguggggcacuuggacugaacaugcauuuggccccugcugucucuccacucuuccccggcgagcggcuguuauuuuuccguuccuauaucccucugaagggugggcacggcgaccccuuuauugauugccuagugccacaagaauggauacagcacuucuaccaggagagcgcgccugcacagucgucuguugcccuccugcgcuaugugaaucccgacacgggaagaacccuuuuugaggcuaaauugcauaaggaaggcuucaucacaguauccucaacugagaacaggccagucauugugccgccuaauggguacuuucgguucgacaguuggguuaaccaauuuuauagccuggcccccaugggaaccgguaacggccgacgcagaauccaguga

SEQ ID NO: 19456 - RNA, 1620 nt, Artificial Sequence
  derived and/or modified sequence opt3 from capsid_protein__Norovirus__BAD88558
augaagauggccagcaacgacgugaaucccuccgauggcucugcugcaaaccuggucccugagguuaauaacgaagugauggcccucgagccaguagugggggcggcuaucgccgcaccggucgccggacagcaaaauauuauagaccccuggaucagaaacaauuucgugcaggcuccugguggcgaauuuaccguuucaccaaggaacgcacccggggagauucuuuggagugccccucugggaccagauuugaaucccuacuuaagccaccugucccggauguauaacggcuacgcugguggguucgaagugcaggucauccuagccggaaaugcguuuacagcaggcaaagugauuuucgccgcuguaccuccaaacuuuccgacugagggccucucucccucgcagguuacgauguucccucauaucauaguggacguccgccaacuggagccagugcuuaucccccugccugaugugcgaaauaacuuuuaucacuacaaucaggcccaugacucaaccuugaagcucauugcaaugcuguauacaccacugcgugcuaacaacgccggggaugacgucuucacuguuagcugcagagugcucaccaggcccaguccggauuuugacuucaucuuuuuaguaccucccacaguggaaucccggaccaaaucuuucacugucccagugcugacaguugaggaaaugaccaauagccgcuuuccuauuccccuugagaaguuguacacgggaccauccucagcguucgugguccagccccagaacgguagauguacuaccgauggcgugcugcuagggacaacucaacucagugccguaaauaucugcaccuucaggggagacguuacacacauagcaggcagccggaacuauaccaugaaucuggcuucucagaacuggaauaacuacgauccuacggaggaaauuccagccccgcuugguauccccgacuuuguggggaaaauucagggacuguugacucagacaacccgcgcugacggcuccacucgagcccauaaggcaacagucucaaccggcagcgugcacuucacgccuaagcucgggaguguccaauuuucuaccgauacagacaaugauuuccagccaggacagaacacuaaauuuacccccguggguguuauccaagacggcgauagacaccagaaugagccucagcagugggugcugccagacuacuccgggaggacaggacauaacguacacuuagcccccgcugucgcgccgacuuucccuggcgaacaacugcucuuuuuccggagcaccaugccagguuguucgggguaucccaauaugaaccuugauugccuguugccucaggagugggugcuacauuuuuaccaggaaucugcacccgcccaguccgacguugcucugcuccguuucgugaauccagauacaaaccgcguccuguuugaguguaaacuucacaagucaggcuauaucaccguggcccacacuggacaacaugaccugauuuugccucccaacggcuacuucagauuugauaguuggguaaaucaguucuauacgcucgcaccaauggggaacggagccgguaggcggcgagcuccguga

SEQ ID NO: 19457 - RNA, 1623 nt, Artificial Sequence
  derived and/or modified sequence opt3 from capsid_protein__Norovirus__BAD98240
augaagauggccagcaacgacgcuacccccuccaaugauggcgcagccgggcuggugccugagucuaacaaugaagcgauggcucucgagccagucguuggagccucacuugcagccccggugacaggucagacuaacaucauugaccccuggauaagaacgaauuucguacaagcuccuaacggcgaauuuaccgugaguccaaggaauagccccggggagauccuggucaacuuggaauuaggaccugagcugaauccauaccuagcacaccucgcccggauguauaacggcuacgcuggugggauggaggugcagguuaugcuggccggaaaugcguucacagcaggcaaaauuaucuuugccgcugugcccccuuauuucccagucgaaaaccuuuccccgucucagauuacuauguuuccccaugugaucauagauguacgcacccuggagccuguuuugcucccaaugcccgacgugcgaucgacacuguuccacuuuaaucagaaggaugaaccuaaaaugcgucuggucgccaugcucuacaccccauuaagaucaaacggcagcggggacgauguguucacugugaguugcaggauccugacacggcccuccccggaguuugacuucaccuaucuugucccucccacgguugagucuaagacuaaaccauuuaccuugccugugcugacacuaggagaacucagcaauucccgcuucccccugucaauugaugagaugguaacuagcccaaacgaaagcaucgugguccaaccccagaacgguagagugacccuugacggcgagcuguuggggacaacccagcuccaggcauguaauauuugcucuaucaggggaaagguuacgggccaagugccuaacgaacagcauauguggaaucuggagauaacuaacuuaaaugguacacaguuugauccaaccgacgaugucccggcuccccugggggugccugacuucgccggagagguauucggcguucucucccagcggaaccgcggcgaaucaaauccagcgaaccgagcccacgacgcaguggucgcuacuuacagcgauaaguauacacccaaacuugggcuggugcaaauuggaaccuggaauacgaacgacgucgagaaucagccuaccaaguuuacaccaaucgguuugaacgaaguggccaauggccauagauucgagcaguggacucuacccagguacaguggggcucugacccucaacaugaaucuggccccggcaguugccccucuuuuuccaggagaacggcuguuguucuuucguucuuacgugccccucaaaggcgguuucgggaacccugcuauugauugucugguaccccaagaguggguccagcacuuuuaucaggaguccgcgccaaguuuaggcgacguggcacugguucgcuacgugaacccugauacaggaagaguccuauucgaagccaagcuccacaaaggcggguuucugacugugucgucuaccuccacaggacccguagugguuccagcuaaugguuauuucagguuugacucaugggucaaccaguucuacagucuugccccgaugggcaccgggaauggacggcgacgcuuucaauga

SEQ ID NO: 19458 - RNA, 1632 nt, Artificial Sequence
  derived and/or modified sequence opt3 from capsid_protein__Norovirus__BAE43833
augaugauggccagcaaggacgcucccaccaacauggauggcacauccggggcaggacagcuggugccugaggccucuacugcggaaccaaucucaauggagccggucgcuggugccgcaacggccgcugcaaccgccggccaaguuaauaugauugaccccuggauaaugaguaacuacgugcaggcuccucagggggaguucacaaucagcccaaauaacacucccggagauauucucuuugaccuucagcugggcccucacuugaauccauucuuaucccaucuggcccaaauguauaacgguuggguagggaauaugaaagugagaguccuacucgcgggaaacgcauuuaccgccggcaagaucauuaucucuugcgugcccccuggcuucgcugcccagaauguuucgauagcacaggcuacaauguuuccacacgugaucgccgaugucagggugcuggaaccgauugaaguaccccuugaggacguucggaacgugcuguuccauaauaacgauucaaccccuacuaugcgcuugaucuguaugcucuacacaccacugcgagcgagcgggaguuccucuggaaccgaccccuuugucauugccggucgugugcugacgugcccuagcccagauuucaauuuucucuucuuagugcccccgaacgucgagcagaaaacuaagccuuuuuccguucccaaucugccacuuaacguguugucaaacaguagaguaccuagccugaucaaaucuaugauggugucccaagaccacggccagaugguccauuuccagauagggagggugacccuagauggacagcuccaaggcacaacucccaccucagcaagccagcuguguaagauucgggguacaguuuaucacgcuaccgggggacagggccuuaaucugacggaaaucgacggcacuccauaccacgccuuugagagucccgcuccuauuggguucccagauuugggagaaugcgacuggcauaucaacgccucuccggcaaaugccuucacagacgguuccaucauucaccgcauagauguggcucaagacagcaccuuugcgccccaucucggcacuauccacuauacaaacgcaaauuacgaugccaacgucucgcugauuuguucuuuagaguggcuguccccuccaucagggggagcucccaaggugaauccuugggccaucccaagauauggcaguacccucacggaggcagcccagcuugcucccccgauauacccuccagguuucggggaagccauuguauuuuucaugagcgacuuucccaucgcaaacggcuccgauggacugucuguuccuugcaccaucccccaggaguucgugacacacuuugucaaugaacaggcgccaacuaggggcgaggcugccuugcuacauuacguggacccugauacccaccggaaccugggggaguucaaacucuaucccgaaggauuuaugacaugugucccaaauagcucagguaguggcccgcaaacucugccuauuaacgggguguucaccuuuaucuccuggguuagccgcuucuaccagcuuaagcccgugggaacaaccggcccaguacgaagacuggguauuaggcggucuuga

SEQ ID NO: 19459 - RNA, 1647 nt, Artificial Sequence
  derived and/or modified sequence opt3 from capsid_protein__Norovirus__BAE48588
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcucggaaaauuaucuucgccgcaauacccccuaacuuuccaaucgacaaucuuagugcugcccauauuaccaugugcccgcacguuaucguggauguccgccagcuggagcccgugaacuugccuaugccagacguacgaaauaacuucuuucauuauaaccaaggcagcgauucccgucucagacugauugcgaugcuguacacaccccucagggccaauaacucuggggacgauguuuucacugugucgugucgggucuuaacccgcccuucaccagacuuuagcuucaauuuucuggugcccccgacacuugaaaguaagaccaaaccuuucacuuugcccauccugacaauauccgagaugucuaacagcagauuuccagugccuauugauucccuacacaccucacccacggaaaauaucgucguucagugccagaacggaagggugacucucgacggugagcugaugggcaccacacagcuucugccaagucaaauuugugcauuccgcgggguauugacucggagcaccucucgagcuagagaucaggccgacacagcuacccccaggcuguucaauuauuacuggcauauccagcucgacaacuuaaauggaacgccuuaugauccagccgaggacaucccgggcccccuggguacuccugauuuucgggggaagguguucggagucgcaucccagcguaacccagacucaacaacccgcgcccacgaagcuaaaguggauacuacagcgggcagauuuacccccaagcucggcagccuugagauuaguacggaaucugacgauuucgaccaaaaucagccuaccagguuuacaccaguugggauaggaguggauaacgaggcagacuuccagcaauggucccugcccgauuacagcggucaguuuacucacaauaugaacuuggccccggcugucgccccuaauuucccaggcgaacagcuacuguuuuuccggucgcagcuccccucuuccgggggacgaucaaacggcauccuggacugccuugugccucaagaguggguacagcauuuuuaccaggagagugcacccagccagacccaaguugcccuggugcgcuaugucaacccagacacagguagaguguuguucgaagcuaagcuccacaaacugggguuuacuaccauugccaagaauggcgauuccccuaucacagugcccccaaacggauacuucagguucgagucuugggucaauccguuuuauaccuuagcaccuaugggcacugggaacggacggcgcagaaaucaguga

SEQ ID NO: 19460 - RNA, 1647 nt, Artificial Sequence
  derived and/or modified sequence opt3 from capsid_protein__Norovirus__BAE48589
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguugaacuuagagcugggcccugaaaucaauccauaccuagcucaccucgccaggauguauaacgguuacgcagggggauucgaggugcaggucgugcuggcgggcaaugccuuuacggcuggcaaaauuaucuucgccgcaauacccccuuauuuuccaaucgacaaccuuagugcugcccagauuaccaugugcccgcauguuaucguggauguccggcaacuggagcccgugaauuugccuaugccagacguacgcaacaauuucuuucacuacaaccaggggagcgauucccgacuccgucugguugcgaugcuguauacaccccucagagccaacaauucuggagacgauguguucacugucucguuaagggugcugacccggccuucaccagacuuuagcuucaacuuucuugugcccccgacagucgaaaguaagaccaaaccuuucacuuugcccauucugacaaucuccgagaugucuaauagccgcuuuccaguuccuauagauucccuacauaccucacccacggaaaacauugugguacagugucagaaugguagagugacucucgacggcgagcugauggggaccacacaacuucugccaagucagaucugcgcauucaggggagucuugacucggagcaccucucgcgcuuccgaucaggccgacacagcuacgccccgacucuucaacuacuauuggcacauucagcuggacaauuuaaacggcaccccuuacgauccagccgaggacaucccggguccccuggggacuccugauuuuagaggaaagguguucggcguugcaucacaaaggaauccagacagcacaacccgggcccaugaagcuaaaguggauacuacagcgggccguuuuacccccaagcucgggagucuugagaucucuacggaauccgacgauuucgaccagaaccagccuacccgcuuuacaccagucggaauugguguggaucacgaggcagacuuccaacaguggagccugcccgauuacucgggccaguuuacucacaauaugaacuuggccccggcuguagccccuaauuucccaggggaacagcuacuguuuuucagaucucaacuccccuccucaggaggcaggaguaacgguauacuggacugucuuguuccucaggagugggugcagcauuuuuaucaggagagcgcacccgcccaaacccaggucgcucuggugcgguacgucaauccagacacagggcgaguguuguucgaagccaagcuccacaaacugggcuuuaugacuaucgcaaagaacggagauuccccuauuaccguucccccaaacggcuauuuccgcuucgagucuugggugaauccguuuuacacauuagcgccuauggggaccggaaacgguagaaggcggauccaguga

SEQ ID NO: 19461 - RNA, 1647 nt, Artificial Sequence
  derived and/or modified sequence opt3 from capsid_protein__Norovirus__BAE48590
augaagauggccagcaacgacgcuacccccuccaaugauggcgcagccgggcuggugccugagaucaacaaugaagcgauggcucucgacccagucgccggagcagccauugcugcaccgcuuacaggucagcaaaacauaaucgaucccuggauuaugaauaacuucguucaggccccuggcggggaguuuacugugucuccaagaaauucacccggagaaguacuguuggacuuagagcugggcccugaaaucaacccauaccuagcucaccucgccaggauguauaaugguuacgcagggggauucgaggugcaggucgugcuggcgggcaacgccuuuacggcuggcaaaauuaucuucgccgcaauacccccuaauuuuccaaucgauaaccuuagugcugcccagauuaccaugugcccgcauguuaucguggacguccggcaacuggagcccgugaauuugccuaugccagauguacgcaacacauucuuucacuauaaucaggggagcgacucccgacuccgucugauugcgaugcuguacacuccccucagagccaacaacucuggagaugacguuuucaccgugucguguagggucuuaacacggccuucaccagauuuuagcuucaauuuucuggugcccccgaccguggaaaguaagacuaaaccuuucacacuucccaucuugaccauauccgagaugucuaacagccgcuuuccagucccuauugacucccugcauacgucacccacugaaaguaucguugugcagugccagaaugguagaguaacccuagauggcgagcucauggggacaacucaacugcuuccaagccagauuugugcauucaggggagugcugacccggucuacaucccgcgcuucagaccaggccgacaccgcuacgccccgauuguucaacuauuacuggcacauccagcucgauaaucugaacggcacuccuuaugacccagccgaggauaucccgggucccuuagggacaccugacuuuagaggaaaggucuucggcguggcaagccaaaggaauccagauaguaccacucgggcccaugaagcuaaaguugacacaaccacgggccguuuuacccccaagcuggggucucucgagauuuccacagaaagcgaugacuucgaucagaaccagccuacucgcuuuaccccagugggaauaggugucgaccacgaggcggauuuccaacaguggucgcuucccgacuacucuggccaguuuacacacaauaugaaccuggcaccggccguggcuccuaauuucagaggggaacaguugcuauuuuucaggucccaacugccaucaaguggaggccggagcaacgguacucucgacugccugguaccccaggaguggguucagcauuuuuaccaggaguccgccccugcacaaacccagguggcccuuguccgauaugugaaucccgauacagggcgcguccuguucgaagcuaaguugcacaaacucggcuuuaugaccaucgccaagaacggagacucuccaauuacugugccucccaauggcuacuucagauucgagagcuggguuaacccauuuuauacgcuggcaccgauggggacaggaaacgguaggcggcgcauccaguga

SEQ ID NO: 19462 - RNA, 1644 nt, Artificial Sequence
  derived and/or modified sequence opt3 from capsid_protein__Norovirus__BAE92970
augaagauggccagcaacgacgcuucccccucuaccgauggcucagcagggcuggugccugaggucaauaacgaaacaauggcccucgagccaguugugggagcgccgcuugcugcccccguagcaggucagcacaauaucauugacccuuggauaaaaaugaacuucgugcaagccccaaauggcgaauuuacugucagucccagaaacgcuccuggggagauccuguuggauuuagaacugggaccagaccuaaaucccuaccucagccaucuggcaaggauguauaacggcuacgccggugggauggaggugcagguugugcuugcuggaaaugccuucacggcgggcaagauuaucuuugcagccgucccuccaaacuucccggcugagaaucuguccgccgcacaggugaccaugugcccccacguaauuguugaugugcggcaguuggaaccugucaugcucccaaugcccgacauccgcaacaaacuguuucauuauaaucaaguggaugacccuaagcugcgacucuuagcuuaccuguauacaccacuucgugccaacaaugcgggcgaugacguguucacugucucuuguagaguuuugaccaggcccacaccggauuuugaguucauguuucuggugccucccaccguagaaucgaaaacuaagccauucucacuaccuagccucacacuggacgagcuuaguaacucccgguuucccgccccaauagugcagcuguacaccaacccccacgauaauuuggucgugcagccucagaacgggcgcugcacgaucgacggacuccugcaagguacuacccaguuaguuucuuguaaugugugcagcuucagaggcacacugggggacggacagccagcaucccauucagaggaagagauuaugccgauggcuuuuaacguccagagggaaaucaugcucgagaaucuugauggcagucccuaugacccuacugaugacauuccagccgugcuggguagccccgauuuccaagggguaguuuucggaaucuugucucagcggaacaccgacggccagacacgcgcucacgaagccaagguggauacccgagcagccagauuugcuccuaaacuaggcuucgucguggcgacggucgaguccacugacuuucacgcaaaucaaccaucaagguucacacccguggggcugggaggugauggcaaccaggacuuuaaucaguggagccucccggccuacgggggagcucugaccaacaauacuaaccuugccccuccagcaaugcccguuuacccuggcgagcagcuguuguucuuucggagucaacuccccucuuccgguggggugguaggcggauggcuggauuguuuacugccacaggaauggguccagcauuucuuucaggagagcgccacaucgcaaucugacguggcucuaguucguuauauaaauccuaccacgggccgcguccucuucgaagccaagcugcacaaacagggguuucuuaccguggcagcguccggaucauaccccuuggugguaccagcugacgguuauuucagauuugagaguugggugaaccaguucuacacacuggccccgaugggcaaugggagcggaaggcgguccgcacgauga

SEQ ID NO: 19463 - RNA, 1623 nt, Artificial Sequence
  derived and/or modified sequence opt3 from capsid_protein__Norovirus__BAE98191
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaacaaauuucgugcaggcuccugguggcgaauuuacuguuaguccaaggaacgcacccggggagauccuuuggagcgccccucugggaccagauuugaaucccuacuuaucccaccuggcucggauguauaacggcuacgccgguggguucgaagugcaggucauucuagcgggaaaugcauuuacggccggcaaaaucauuuucgcugccgugccuccaaacuuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaacgccggggaugacguguucacagucaguugcagaguucugaccaggcccuccccggauuuugacuucauuuuucucgugccucccacuguagaaucucggacaaaaccauucaccgugccuaucuuaacggucgaggaaaugacuaacagccgcuuucccauaccacuggagaaacuuuucaccggacccuccucagcguucgugguucagccucagaaugguagauguacaacugauggcguguugcuggggaccacacaacuaaguccagucaacauuugcaccuuuaggggagacgugauccauauuccgggcacgcggacuuaccgcaugaaucucgccagccagaacuggaauaacuaugaucccacagaggaaaucccugcaccacuggguacccccgacuucguagggaagauccagggaaugcuuacucagacaaccaagggcgacggcucuacgcgagggcacaaggcuaccguuuccacaggaucaguggauuuuacuccuaaacuggguagcguccaauucgccaccgacacagauaaugacuuugagacuggccagaacaccagauucacaccagugggggucauucaggauggaaguucugcucauaggaaugaaccccaacaguggguguugccggacuacuccggccggaccguucacaacgugcaccucgccccugcaguagccccaacuuuucccggugagcagcuguuauucuuucguagcacgaugccuggguguucgggcuaccccaauauggaucuggacugccuccuuccacaggaauggguccaacauuucuaucaggaggcugcgccuucucaguccgauguggcacuguugcgcuuuguuaaccccgacacaggaagagugcuauucgaguguaagcugcacaaagccggcuacgucaccguggcucauacugggcagcacgaucucguaauaccaccgaauggauauuuuagguucgacucaugggugaaccaauucuacacccuggccccuauggguaauggcgcagggcggcgacgcgcccuuuga

SEQ ID NO: 19464 - RNA, 1623 nt, Artificial Sequence
  derived and/or modified sequence opt3 from capsid_protein__Norovirus__BAE98194
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucccgggcacgcggacuuaccgcaugaaccucgccagccagaauuggaacaauuaugaucccacagaggaaauuccugcaccacuggguacccccgacuucguagggaagauccagggaaugcuuacucagacaaccaagggcgacggcucuacgcgagggcacaaggcuaccguuuccacaggaucaguggauuuuacuccuaaacuggguagcguccaauucgccaccgacacagauaacgacuuugagacuggccagaauaccagauucacaccagugggggucauccaggauggaaguucugcucauaggaacgaaccccaacaguggguguugccggacuacuccggccggaccguucacaaugugcaccucgccccugcaguagccccaacuuuucccggugagcagcuguuauucuuucguagcacgaugccuggguguucgggcuaccccaacauggaucuggacugccuccuuccacaggaauggguccaacauuucuaucaggaggcugcgccuucucaguccgauguggcacuguugcgcuuuguuaaucccgacacaggaagagugcuauucgaguguaagcugcacaaagccggcuacgucaccguggcucauacugggcagcacgaucucguaauuccaccgaacggauauuuuagguucgacucaugggugaaucaauucuacacccuggccccuauggguaacggcgcagggcggcgacgcgcccuuuga

SEQ ID NO: 19465 - RNA, 1623 nt, Artificial Sequence
  derived and/or modified sequence opt3 from capsid_protein__Norovirus__BAE98197
augaagauggccagcaacgacgcuucccccucugauggcucaaccgcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugacgaauagccgcuuucccauaccacuggagaaacuuuucacuggacccuccucagcguucgugguucagccucagaacgguagauguaccacagauggcguguugcuggggacuacccaacuaaguccagucaauauuugcacauuuaggggagacgugacccauaucagcggcacgcggacuuaccgcaugaaccucgccucucagaauuggaacaauuaugauccgacagaggaaauucccgcaccucuggguaccccagacuucguagggaagauccagggaaugcuuacucagacaaccaagggcgacggcuccacgcgagggcacaaggcuaccguuucaacaggaagcguggauuuuacucccaaacuggguaguguccaauucgccaccgacacagauaacgacuuugagacuggccagaauaccagauucacaccugugggggucauccaggauggaucuuccacccauaggaacgaaccacaacaguggguguugcccgacuacagcggccggacuguucacaaugugcaccucgcuccggccguagcaccuacguuuccaggugagcagcuguuauucuuucguucgacaaugcccggguguucuggcuacccuaacauggaucuggacugccuccuuccccaggaauggguccaacauuucuaucaggaggccgcuccaucccagucagauguggcgcuguugcgcuuuguuaauccugacaccggaagagugcuauucgaguguaagcugcacaaagcaggcuacgucacuguggcccauaccgggcagcacgaucucguaauucccccaaacggauauuuuagguucgacaguugggugaaucaauucuacacacuggcuccgauggguaacggcgccgggcggcgacgcgcacuuuga

SEQ ID NO: 19466 - RNA, 1623 nt, Artificial Sequence
  derived and/or modified sequence opt3 from capsid_protein__Norovirus__BAF45861
augaagauggccagcaacgacgcuaaucccuccgauggcucugcagccaaccuggugccugaggucaauaacgaaguuauggcgcucgagccagugguaggggcugccaucgcagccccgguggcuggacagaccaaugucauugaccccuggauaagaaacaauuucgugcaagcaccugguggcgaauuuacaguuucaccaaggaacgcccccggggagauccuuuggagugcuccucugggaccagauuugaaucccuacuuaagccaccuggcccggauguauaacggccaugcggguggguucgaagugcaggucauucuagcaggaaaugccuuuacugcuggcaaaaucauuuucgccgcagugccuccaaacuuuccgacggagggccucucccccucucagguaaccauguucccucacaucauaguugacgugcgccagcuggagccaguccuuaucccccugccugaugugcgaaauaacuuuuaccauuauaaucaaucgaacgacucaacaauuaaguugaucgcuaugcucuacacuccacugcgugccaacaaugcgggggaagauguguucaccgucagcugcagaguucugacaaggcccaguccggacuuugauuucauuuuucucgugccucccaccguagagucccggacuaaaccauucacagugccuaucuuaaccgucgaagagaugacgaacucucgcuuucccauaccacuggagaaacuuuucacuggacccagcggugccuucgugguucagccucagaauggcagauguaccacagacgggguguugcugggaacuacccagcuauccccagucaacauuugcacauuuaggggcgaugugacccacaucgcagguucacggaauuauacgaugaaccucgcuagucugaauuggaacaauuacgacccgacugaagagauucccgccccucuugggacaccagauuucguaggaaagauccaaggcguucugacccagacuacaaagggcgacgggagcacccgcggacauaaggcuacgguguauaccgguucugcccccuuuacaccuaaauugggcuccguccaguucucaacugacaccgaaaacgauuuugagacacaccagaauacuaaguucaccccagugggggucauccaagacggaagcacaacccaccgaaacgaaccccagcagugggugcucccgaguuacucuggcagaaauguucauaacgugcaccuggccccugcaguagcuccaacuuuucccggugagcaauuacuguucuuuagguccacgaugccuggguguagcggcuaccccaauauggaucucgacugccuucugccacaggaguggguccagcauuucuaucaggaagcggccccugcacaaucggauguggcuuugcuacgguuuguuaaccccgacacaggacgugugcuguucgaguguaaacuccacaagucuggcuacgucaccguggcccacacugggcagcaugaucugguaauuccaccgaacggauauuuucgcuucgacuccugggugaaucaguucuacacccuugcaccuauggguaacggcacagggagaaggcgggcccuguga

SEQ ID NO: 19467 - RNA, 1620 nt, Artificial Sequence
  derived and/or modified sequence opt3 from capsid_protein__Norovirus__BAF74508
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaucaaauuucgugcaggcuccugguggcgaauuuacuguuaguccaaggaacgcacccggggagauccuuuggagcgccccucugggaccagauuugaaucccuacuuaucccaccuggcucggauguauaacggcuacgccgguggguucgaagugcaggucauucuagcgggaaaugcauuuacggccggcaaaaucauuuucgcugccgugccuccaaacuuuccgaccgagggccucucucccucgcagguaacaauguucccucauaucauaguugacgugcgccaacuggagccaguccuuaucccccugccugaugugcgaaauaacuuuuaucacuacaaucagucaaacgacagcacuauuaaguugaucgcaaugcucuauaccccacugcgugcuaauaacgccggggaugacguguucacagucaguugcagaguucugaccaggcccuccccggauuuugacuucauuuuucucgugccucccacuguagaaucucggacaaaaccauucaccgugccuaucuuaacggucgaggaaaugagcaacucccgcuuucccauaccacuggagaaacuuuacacuggacccucaagugcguucgugguucagccucagaaugguagauguaccacagauggcguguugcuggggacuacccaacuaagcgccgucaacauuugcacauucaggggagacgugacccauaucgcaggcucucacgauuauacgaugaaucucgcuucccagaacuggaauaacuacgacccaacugaggaaauuccggcuccccuggguacaccugacuuuguagggaagauccagggaguucuuacccagacuacacggggcgauggcucaacccgcgcccauaaggccacggugagcaccgggaguguccacuucacaccaaagcugggaucugugcaauacacuaccgacacaaauaacgauuuucagacuggucagaauaccaaauucacacccgucggcgugauccaagacggggauaaccaccagaaugagccucagcaguggguuuugccaaacuauuccggacgaaccggccauaaugugcaccucgcacccgccguagcuccgacuuuuccuggugaacaacuguuauucuuuagaagcacgaugccaggguguucgggcuaccccaacaugaaucuggacugccuccuuccucaggaguggguccagcauuucuaucaggaagcggcacccgcccaaucugauguggcucuguugagguuuguuaacccagacacaggacgggugcuauucgaguguaagcugcacaaauccggcuacgucaccguggcccacacugggccucaugaucucguaauucccccaaacggauauuuucguuucgacucaugggugaaucaguuuuacacccuggcaccgauggguaacggcgccgggcgcagaagggcucuuuga

SEQ ID NO: 19468 - RNA, 1620 nt, Artificial Sequence
  derived and/or modified sequence opt3 from capsid_protein__Norovirus__BAF74509
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuacacgggacccuccucagcguucgugguucagccucagaaugguagauguacuaccgauggcguguugcuggggacaacucaacuaagugccgucaacauuugcaccuucaggggagacgugacacauaucgcaggcagccacgauuauaccaugaaucucgcuucucagaacuggaauaacuacgacccaacggaggaaauuccggcuccccuggguacuccugacuuuguagggaagauccagggaaugcuuacacagaccacucgggaggauggcuccacacgcgcccauaaggccaccguuucaacgggcagcgugcacuucaccccaaagcuggggaguguccaauacacaacugacaccaauaacgauuuucagacaggacagaauacuaaauucacccccgugggugucauccaagacggcaacaaucaccagaacgaaccucagcaguggguguugccaaauuauucugggcgaacaggacauaacguucaccucgcacccgccguggcuccgaccuuuccuggcgagcaacuguuauucuuuagauccacuaugccagguuguagcggguaccccaacaugaaucuggauugccuccuuccucaggaauggguacagcauuucuaucaggaggcggcacccgcccaaucggacgucgcucuguugagguuugugaacccagauacgggccggguucuauucgaguguaagcugcacaaaucuggauacgugacagucgcccacaccggcccucaugaccucgugauucccccaaauggguauuuucguuucgauuccuggguaaaccaguuuuacacucuggcaccgaugggaaauggugccggccgcagaagggcucuuuga

SEQ ID NO: 19469 - RNA, 1620 nt, Artificial Sequence
  derived and/or modified sequence opt3 from capsid_protein__Norovirus__BAF74510
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucuuuugcagaguucugacaaggcccagcccggauuucgacuuuauuuuccucgugccucccaccguagaaagucggacuaaaccauuuacagugccuaucuuaaccgucgaggaaauguccaacucucgcuuccccauaccacuggagaaacuuuacacgggacccagcuccgcguucgugguucagccucagaaugguagauguacuaccgauggcguguugcuggggacaacucaacuaucagccgucaacauuugcaccuuuaggggagacgugacacauaucgcaggcagucacgauuauaccaugaaucucgcuagccagaacuggaauaacuacgacccaacggaggaaauuccggcuccccuggguacuccugacuucguagggaagauccagggaaugcuuacacagaccacucgggaggauggcucuacacgcgcccauaaggccaccguuuccacgggcucagugcacuuuaccccaaagcuggggagcguccaauacacaacugacaccaauaacgauuuccagacaggacagaauacuaaauuuacccccgugggugucauccaagacggcaacaaucaccagaacgaaccucagcaguggguguugccaaauuauagugggcgaacaggacauaacguucaccucgcacccgccguggcuccgaccuucccuggcgagcaacuguuauuuuucagaucuacuaugccagguuguuccggguaccccaacaugaaucuggauugccuccuuccucaggaauggguacagcauuuuuaucaggaggcggcacccgcccaaagcgacgucgcucuguugagguucgugaacccagauacgggccggguucuauuugaguguaagcugcacaaaucgggauacgugacagucgcccacaccggcccucaugaccucgugauucccccaaauggguauuuccguuuugauucuuggguaaaccaguucuacacucuggcaccgaugggaaauggugccggccgcagaagggcucuuuga

SEQ ID NO: 19470 - RNA, 1620 nt, Artificial Sequence
  derived and/or modified sequence opt3 from capsid_protein__Norovirus__BAF74511
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccauaccacuggagaaacuuuucacgggacccuccucagcguucgugguucagccucagaaugguagauguacuaccgauggcguguugcuggggacaacucaacuaagugccgucaacauuugcaccuuuaggggagacgugacacauaucgcaggcagccacgauuacaccaugaaucucgcuucucagaacuggaauaacuaugacccaacggaggaaauuccggcuccccuggguacuccugacuucguagggaagauccagggaaugcuuacacagaccacucgggaggauggcuccacacgcgcccauaaggccaccguuucaacgggcagcgugcacuuuaccccaaagcuggggaguguccaauacacaacugacaccaauaacgauuuccagacaggacagaauacuaaauuuacccccgugggugucauccaagacggcaacaaucaccagaacgaaccucagcaguggguguugccaaauuacucugggcgaacaggacauaacguucaccucgcacccgccguggcuccgaccuucccuggcgagcaacuguuauuuuucagauccacuaugccagguuguagcggguaucccaacauggaucuggacugccuccuuccucaggaauggguacagcauuuuuaccaggaggcggcacccgcccaaucggaugucgcucuguugagguucgugaauccagacacgggccggguucuauuugaguguaagcugcacaaaucuggauaugugacagucgcccacaccggcccucaugaucucgugauucccccaaacggguacuuccguuuugacuccuggauaaaucaguucuauacucuggcaccgaugggaaacggugccggccgcagaagggcucuuuga

SEQ ID NO: 19471 - RNA, 1620 nt, Artificial Sequence
  derived and/or modified sequence opt3 from capsid_protein__Norovirus__BAF74512
augaagauggccagcaacgacgcuacccccuccgauggcucuacagcaaaucuggugccugaggucaacaaugaaguuauggcccucgagccagugguaggggcggcuaucgccgcaagaguggccggacagcaaaacgucauugacccguggauaaggaauaacuucgugcaggcucccgguggcgaauuuacuguuucaccucggaaugcaccaggggagauccuuuggagugcaccccugggaccugauuugaacccauacuuaagccaccuggcucgcauguauaauggcuacgccgguggguucgaagugcaggucauucuagcgggaaacgcauuuacggccggcaaaaucauuuucgcugccgugcccccuaauuuuccaaccgagggccucuccccgucucagguaacaauguucccccauaucauaguugacgugcgacaacuggagccuguccuuaucccacugcccgaugugcguaacaauuuuuaucacuacaaccagucgaaugacucaacuauuaaguugaucgcaaugcucuauaccccucugagagcuaacaacgccggggaugacguguucacagucagcugcaggguucugacccggccaagucccgauuuugacuucauuuuucucgugccgccuacuguagaaucccgcacaaaacccuucaccgugccaaucuuaacggucgaggaaaugucuaauagcagauuuccugugccccuggagaaacuuuacacuggaccauccucagcguucguugugcagccccagaacgguagguguaccacagauggcgucuugcuggggacuacccaacuaagugccgugaauauaugcacauuccggggagacguaacccauauugcaggcagccacgauuauacgaugaaccucgcuucucagaauuggaacaauuacgacccuacugaggaaaucccagccccgcuggguacacccgacuuuguugggaagauucagggagugcuuacccagacuacacgcgaggauggcuccacccgagcucauaaggccacggucucaaccggcagcgugcacuucacaccuaagcuggggaguguccaauacacuaccgacacaaacaaugauuuucagacuggacagaacaccaaauucacaccaguggguguuauccaagacggcucuaaucaccagaacgaaccccagcaguggguguugccuaauuauuccgggagaaccggacauaacguacaccucgcaccagccgucgcucccacuuuuccgggcgagcaacuguuauucuuuaggagcacgaugccugguuguucgggguacccaaauaugaaccuggauugccuccuuccccaggaaugggugcagcauuucuaucaggaggcggccccugcccaaucugacguugcucuguugcgguuugugaaccccgauacaggccguguccuauucgaguguaagcugcacaaauccggauacgugaccguagcccacacuggcccacaugaccucgugaucccucccaauggguauuuucgcuucgauucauggguuaaccaguuuuacacccuggcaccaaugggaaauggugccggcagaaguagcgcucuuuga

SEQ ID NO: 19472 - RNA, 1620 nt, Artificial Sequence
  derived and/or modified sequence opt3 from capsid_protein__Norovirus__BAF74513
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaucaaacuucgugcaggcuccugguggcgaauuuacaguuaguccaaggaaugcacccggggagauccuuuggagcgccccucugggaccagauuugaaccccuacuuaucccaccuggcucggauguauaauggcuacgccgguggguucgaagugcaggucauucuagcgggaaacgcauuuacugccggcaaaaucauuuucgcugccgugccuccaaauuuuccgacggagggccucucucccucgcagguaaccauguucccucauaucauaguugacgugcgccaacuggagccaguccuuaucccccugccugaugugcgaaacaauuuuuaucacuacaaccagucaaaugacagcacaauuaaguugaucgcaaugcucuauacuccacugcgugcuaacaacgccggggaugacguguucaccgucaguugcagaguucugacaaggcccuccccggauuuugacuucauuuuucucgugccucccaccguagaaucucggacuaaaccauucacagugccuaucuuaaccgucgaggaaaugagcaauucccgcuuucccgugccacuggagaaacuuuacacgggacccucaagugcguucguugugcagccucagaacgguagauguacuaccgauggcgucuugcuggggacaacucaacuaagcgccgugaauauaugcaccuucaggggagacguaacacauauugcaggcucucacgauuauaccaugaaccucgcuucccagaauuggaacaauuacgacccaacggaggaaaucccggcuccccuggguacuccugacuuuguugggaagauucagggagugcuuacacagaccacucgggaggauggcucaacacgcgcccauaaggccaccgucagcacgggcagugugcacuucaccccaaagcuggggucuguccaauacacaacugacaccaacaaugauuuucagacaggacagaacacuaaauucacccccguggguguuauccaagacggcuccaaucaccagaacgaaccucagcaguggguguugccaaauuauagcgggcgaacaggacauaacguacaccucgcacccgccgucgcuccgaccuuuccuggcgagcaacuguuauucuuuagaucgacuaugccagguuguucuggguaccccaauaugaaccuggauugccuccuuccucaggaaugggugcagcauuucuaucaggaggcggcacccgcccaauccgacguugcucuguugagguuugugaacccagauacgggccggguccuauucgaguguaagcugcacaaaucaggauacgugacaguagcccacaccggcccucaugaccucgugauucccccaaauggguauuuucguuucgauaguuggguuaaccaguuuuacacucuggcaccgaugggaaauggugccggccgcagaagggcucuuuga

SEQ ID NO: 19473 - RNA, 1623 nt, Artificial Sequence
  derived and/or modified sequence opt3 from capsid_protein__Norovirus__BAF74514
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacacucaggggcgaugugacccauaucgccgguacgcacaauuacacuaugaaccuggcaucccagaauuggaacaauuaugaccccacagaagagauuccugcuccacuugggacccccgauuuuguaggacggauccagggcguucugacucagacaacccgcggcgacgggucaacgcgaggacauaaggccaccgugaguacaggugacguccacuucacuccuaaguugggcagcgugcaauuuaacaccgauacaaauaacgacuucgaaaucgggcagaauacuagauuuaccccagucggagugguucaggauggcaacgguacacaccaaaaugagccccagcagugggugcucccgucuuacuccgggaggaccggccauaacguacaccuggcuccugccgucgcaccaacuuuccccggagaacaguuacuguuuuuccggucaacgaugccuggcuguagcggguaccccaacaugaaucucgacugccuucugccacaagagugggugcagcauuuuuaucaggaggccgcuccugcgcagagugauguugcauugcuacguuucgugaaccccgacacaggacgcguccuguuugaauguaagcuccacaaaucugguuacgugaccguagcccacacuggccaacaugaucuggugauuccaccgaauggguauuucagauuugacuccuggguuaaccaguucuacacccuugcuccuaugggaaauggcacagguaggcggcgagcccuguga

SEQ ID NO: 19474 - RNA, 1620 nt, Artificial Sequence
  derived and/or modified sequence opt3 from capsid_protein__Norovirus__BAF74515
augaagauggccagcaacgacgcuaaucccuccgauggcucugcagccaaccuggugccugaggucaauaacgaaguuauggcgcucgagccagugguaggggcugccaucgcagccccgguggcuggacagcaaaauauuauagaccccuggaucagaaacaauuucguccaggcaccugguggcgaauuuaccgugucaccaaggaacgcccccggggagauucuuuggagugcuccucugggaccagauuugaaucccuacuuaagccaccugucccggauguauaacggcuacgccgguggguucgaaguucaggugauccuagcgggaaaugcauuuacagccggcaaagucauuuucgcugccgugccuccaaacuuuccgacugagggccucucucccucgcagguaacgauguucccucauaucauaguugacgugcgccaacuggagccaguccuuaucccccugccugaugugcgaaauaacuuuuaucacuacaaucaggcacaugacucaaccuugaagcucauugcuaugcuguauacaccacugcgugccaacaacgcgggggaugacguguucacugucagcugcagaguucucaccaggcccaguccggauuuugacuucaucuuuuuagugccucccacaguagaaucccggaccaaaccauucacugugccuguccugacaguggaggaaaugaccaauucucgcuuucccauuccacuugagaaguuguacacgggacccagcuccgccaucguugugcagccucagaacgguagauguacuaccgauggcguccugcuagggacaacucaacucucagcagugaauauaugcaccuucaggggagacguaacacacauugcuggcagucggaacuauaccaugaaucuggccagccagaacuggaauaacuacgauccaacggaggaaaucccggcuccccuugguacuccugacuucguugggaaaauucagggacuguugacacagaccacucgcgccgacggcucuacacgagcacauaaggccaccguguccacgggcucaguccacuuuaccccaaagcucgggagcgugcaauucaguacagauacugacaaugauuuucagcccggacagaacaccaaauucacaccugucggugugauccaagacggcgauagacaccagaaugagccacagcaguggguucugcccgacuuuucugggaggacuggacauaacgugcacuuagcuccggcgguagcaccuaccuucccaggcgaacaacugcucuuuuuccgguccacaaugcccggucguagcggguacccuaauaugaaccuugauugucuguugccccaggaguggguccuacauuuuuaucaggaaucggccccagcucagucugacguggcccugcuccgcuucguuaauccugauaccaacagagugcuguuugagugcaaacuucacaaguccggcuacaucacugucgcacacacgggacaucacgaccugauuuugcccccaaacggcuauuucagguuugauucaugggugaaucaauucuacacacucgccccgauggggaacggagcuggucggcgacgcgccccuuga

SEQ ID NO: 19475 - RNA, 1623 nt, Artificial Sequence
  derived and/or modified sequence opt3 from capsid_protein__Norovirus__BAF74516
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucgugcuagcgggaaacgcauuuacggccggcaaaauuaucuucgcugccguaccuccaaauuuuccgaccgagggccucucccccucucagguuacaauguucccucauauuaucguggacguccgccaacuggagccagugcuuauaccccugccugaugugcgaaacaauuuguaucacuacaaccagucgaaugacccaacuaucaagcucauugcaaugcuguauacaccccugcgugcuaacaacgccggggaagaugucuuuaccguuucaugcagagugcucaccaggccgagcccugacuucgauuuuaucuucuuaguacccccaacuguggagagucggacaaaaccuuuuaccguccccauucugacgggagaagagaugacuaauucccgcuucccaaucccccuugagaaguuguuuaccgguccuucuggcgcguucgugguucagccacagaacgggagauguacaacugacggagugcugcuaggcaccacacaacuccugccggucaauauaugcaccuucaggggugaugugacgcauauugccgggacucacaacuacacaaugaaucuugcaagccagaacuggaauaacuaugaccccaccgaagagaucccugcuccacugggaacucccgauuuuguaggccggauucagggcauguugacacagaccacgcgcggggacggauccacccgaggucauaaagccacaguuucaacuggcgacgugcacuucaccccuaagcucgggaguauccaauuuaauacagauacuaacaaugacuucgaaaccggacagaacacaaaguuuaccccagucggcgugguccaggaugguaaugggacucaccaaaacgagccccagcagugggugcugccgagcuacucuggcagaacgucccauaauguucacuuagcuccugccguggcaccaacauuccccggagaacagcugcucuuuuucaggucaaccaugccuggcuguagcggguaccccaacaugaaccuugacugccuguugccacaagaguggguacagcauuuuuaucaggaggccgcuccugcgcagagugaugucgcacuacugcgguucgugaaucccgacacuggacguguucucuuugaauguaaacugcacaagucugguuacgugaccgucgcccacacaggccaacaugaucuugugaucccaccgaacggguauuuccgcuuugacuccuggguaaaucaguucuacacccuggcuccuaugggaaacggcacugguagaaggcgggccuuguga

SEQ ID NO: 19476 - RNA, 1623 nt, Artificial Sequence
  derived and/or modified sequence opt3 from capsid_protein__Norovirus__BAF74517
augaagauggccagcaacgacgcuaaucccuccgauggcucugcagccaaccuggugccugaggucaauaacgaaguuauggcgcucgagccagugguaggggcugccaucgcagccccgguggcuggacagcaaaaugucauugaccccuggauaagaaacaauuucgugcaggcaccugguggcgaauuuaccguuucaccaaggaacgcccccggggagauccuuuggagugcuccucugggaccagauuugaaucccuacuuaagccaccuggcccggauguauaacggcuacgcggguggguucgaagugcaggucauucuagcaggaaaugccuuuacagcuggcaaaaucauuuucgccgcagugccuccaaacuuuccgacugagggccucucccccucucagguaacgauguucccucauaucauaguugacgugcgccaacuggagccaguccuuaucccccugccugaugugcgaaauaacuuuuaucacuacaaucagucgaacgacucaaccauuaaguugaucgcuaugcucuauacaccacugcgugccaacaaugcgggggaagauguguucacugucagcugcagaguucugaccaggcccaguccggacuuugauuucauuuuucucgugccucccacaguagagucccggaccaaaccauucacugugccuaucuuaacagucgaagagaugaccaacucucgcuuucccauaccacuggagaaacuuuucacgggacccagcggugccuucgugguucagccucagaauggcagauguacuaccgacgggguguugcugggaacaacucaacuauccccagucaacauuugcaccuuuaggggcgaugugacacauaucgcagguacccacaauuacacgaugaaccucgcuucacagaauuggaacaauuaugacccgacugaagagauucccgccccucuggggacaccagauuucguaggacggauccagggcaugcuuacccagacuacacgcggcgacgggaguacccgaggacauaaggcuacgguuagcaccggugacgugcacuuuacacccaagcugggcucuauccaauucaacacugauaccaauaacgacuuugaaacagggcagaauacuaaguucaccccugucggagugguccaggauggcaacggugcccaccaaaaugagccacagcaguggguguugcccuccuacucagggagaacaggccauaacguucaccucgcaccggccguggcuccuaccuuuccaggagaacagcuguuauucuuuaggagcacuaugcccggcuguaguggguacccuaacaugaaucuggacugccuccuuccccaagaguggguacagcauuucuaucaggaggcggcaccagcccagucugaugucgcucuguugcgguuugugaacccugacacgggacguguucuauucgaauguaaacugcacaaguccgguuacgugacagucgcccacaccggccaacaugaucucgugauucccccaaauggguauuuucgcuucgacagcuggguaaaccaguucuacacucuggcaccgaugggaaauggcaccgguagaaggcgggcccuuuga

SEQ ID NO: 19477 - RNA, 1623 nt, Artificial Sequence
  derived and/or modified sequence opt3 from capsid_protein__Norovirus__BAF74518
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcguccaauucaacaccgauacaaauaacgacuuugaaacugggcagaauaccagauucacaccagugggagucgugcaggauggcaacgguacccaccaaaaugagccccagcaguggguuuugccgucuuacuccgggaggacuggccauaacgugcaccucgcuccugccguagcaccaacguuucccggagaacagcuguuauucuuucggucaacaaugccuggcuguagcggguaccccaacaugaaucuggacugccuccuuccacaagaguggguccagcauuucuaucaggaggccgcuccugcgcagagugauguggcacuguugcguuuuguuaaccccgacaccggacgcgugcuauucgaauguaagcugcacaaaucugguuacgucacuguggcccacaccggccaacaugaucucguaaucccaccgaauggguauuuuagauucgacuccugggugaaccaguucuacacacuggcuccuaugggaaauggcaccgguaggcggcgagcccuuuga

SEQ ID NO: 19478 - RNA, 1623 nt, Artificial Sequence
  derived and/or modified sequence opt3 from capsid_protein__Norovirus__BAF74519
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacaccccugcgugcuaacaacgccggggaagauguguucaccgucucaugcagaguucugaccaggccgagcccugacuuugauuucauuuuucucgugcccccaacuguagagagucggacaaaaccuuucaccgugcccaucuuaacggucgaagagaugacuaauucccgcuuuccaauaccccuggagaaacuuuucaccggaccuucuggugcguucgugguucagccacagaacggcagauguacaacugacgggguguugcugggaaccacacaacuaagcccggucaauauuugcaccuuuaggggcgaugugacgcauaucgccgguacucacaacuacacaaugaaucucgcaucccagaacuggaauaacuaugaccccaccgaagagauuccugcuccacuggggacucccgauuucguaggacggauccagggcaugcuuacacagaccacgcgcggcgacgggucaacccgaggacauaaggccacaguuaguacuggugacgugcacuuuaccccuaagcugggcagcauccaauucaauacagauacuaacaaugacuuugaaaccgggcagaacacaaaguucaccccagucggagugguccaggauggcaaugguacucaccaaaacgagccccagcaguggguguugccgucuuacuccgggagaacgggccauaauguucaccucgcuccugccguggcaccaacauuucccggagaacagcuguuauucuuuaggucaaccaugccuggcuguagcggguaccccaacaugaaccuggacugccuccuuccacaagaguggguacagcauuucuaucaggaggccgcuccugcgcagagugaugucgcacuguugcgguuugugaaucccgacacuggacguguucuauucgaauguaaacugcacaagucugguuaccucaccguggcccacacaggccaacaugaucuggucauuccaccgaacggguauuuucgcuucgacuccugggugaaucaguucuacacccuugcuccuaugggaaacggcacugguagaaggcgggcccuguga

SEQ ID NO: 19479 - RNA, 1623 nt, Artificial Sequence
  derived and/or modified sequence opt3 from capsid_protein__Norovirus__BAF74520
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacccaacaauuaaguugaucgcaaugcucuauacuccccugcgugcuaacaaugccggggaagauguguucaccgucucaugcagaguucugacaaggccgagcccugacuuugauuucauuuuucucgugcccccaaccguagagagucggacuaaaccuuucacagugcccaucuuaaccgucgaagagaugacgaacucccgcuuuccaauaccccuggagaaacuuuucacuggaccuucuggugcguucgugguucagccacagaauggcagauguaccacagacgggguguugcugggaacuacccaacuaagcccggucaacauuugcacauuuaggggcgaugugacccauaucgccgguacgcacaauuacacuaugaaccucgcaucccagaauuggaacaauuaugaccccacagaagagauuccugcuccacuggggacccccgauuucguaggacggauccagggcaugcuuacucagacaacccgcggcgacgggucaacgcgaggacauaaggccaccguuaguacaggugacgugcacuuuacuccuaagcugggcagcauccaauucaacaccgauacaaauaacgacuuugaaacugggcagaauaccaaguucacaccagucggagugauucaggauggcaacggugcucaccaaaaugagccccagcagugggucuugccgucuuacuccgggagaaccggccauaacgugcaccucgccccugcaguugccccaacuuuucccggagaacagcuguuauucuuuaggucaacgaugccuggcuguagcggguaccccaacaugaaucuggacugccuccuuccacaagagugggugcagcauuucuaucaggaggcugcgccugcacagagugauguagcccuguugcgguuugucaaccccgacacaggacgugugcuauucgaauguaaacugcacaagucugguuacauaaccguugcucacacuggccaacaugaucucgugaucccaccgaauggguauuuucgcuucgacuccugggucaaccaguucuacacccuggccccuaugggaaauggcacagguagaaggcgggcacuuuga

SEQ ID NO: 19480 - RNA, 1623 nt, Artificial Sequence
  derived and/or modified sequence opt3 from capsid_protein__Norovirus__BAF74521
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucauugaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccauccuuuccgacggagggccucucucccucgcagguaaccauguucccucauaucauaguugacgugcgccaacuggagccaguccuuaucccccugccugaugugcgaaacaauuuuuaucacuacaaccagucaaaugacccaacaauuaaguugaucgcaaugcucuauacuccccugcgugcuaacaacgccggggaagauguguucaccgucagcugcagaguucugacaaggccgaguccugacuuugauuucauuuuucucgugcccccaaccguagagucccggacuaaaccuuucacagugcccaucuuaaccgucgaagagaugacuaauucucgcuuuccaauaccccuggagaaacuuuucacgggaccuagcggugcguucgugguucagccacagaacggcagauguaccacagacgggguguugcugggaacuacccaacuauccccggucaauauuugcacauuuaggggcgaugugacccauaucgccgguacgcacaacuacacuaugaaucucgcaucacagaacuggaauaacuaugaccccacagaagagauuccugcuccacuggggacccccgauuucguaggacggauccagggcaugcuuacucagacaacccgcggcgacgggaguacgcgaggacauaaggccaccguuagcacaggugacgugcacuuuacuccuaagcugggcucuauccaauucaauaccgauacaaacaaugacuuugaaacugggcagaacaccaaguucacaccagucggagugguccaggauggcaaugguacccaccaaaacgagccccagcaguggguguugccguccuacucagggagaacuggccauaauguucaccucgcuccugccguggcaccaacguuucccggagaacagcuguuauucuuuaggagcacaaugccuggcuguaguggguaccccaacaugaaccuggacugccuccuuccacaagaguggguacagcauuucuaucaggaggccgcuccugcgcagucugaugucgcacuguugcgguuugugaaucccgacaccggacguguucuauucgaauguaaacugcacaaguccgguuacgugacugucgcccacaccggccaacaugaucucgugauuccaccgaacggguauuuucgcuucgacagcuggguaaaucaguucuacacacuggcuccuaugggaaacggcaccgguagaaggcgggcccuuuga

SEQ ID NO: 19481 - RNA, 1623 nt, Artificial Sequence
  derived and/or modified sequence opt3 from capsid_protein__Norovirus__BAF74522
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccauccuuuccgaccgagggccucucucccucgcagguaacaauguucccucauaucauaguugacgugcgccaacuggagccaguccuuaucccccugccugaugugcgaaauaacuuuuaucacuacaaucagucaaacgacccaacuauuaaguugaucgcaaugcucuauaccccucugcgugcuaauaacgccggggaagauguguucacagucagcugcagaguucugaccaggccgaguccugacuuugauuucauuuuucucgugcccccaacuguagagucccggacaaaaccuuucaccgugcccaucuuaacggucgaagagaugacuaacucucgcuuuccaauaccccuggagaaacuuuucaccggaccuagcggugcguucgugguucagccacagaauggcagauguacaacugacgggguguugcugggaaccacacaacuauccccggucaacauuugcaccuuuaggggcgaugugacgcauaucgccgguacucacaauuacacaaugaaccucgcaucacagaauuggaacaauuaugaccccaccgaagagauuccugcuccacuggggacucccgauuucguaggacggauccagggcaugcuuacacagaccacgcgcggcgacgggaguacccgaggacauaaggccacaguuagcacuggugacgugcacuuuaccccuaagcugggcucuguccaauucgauacagacacuaacuccgauuuugaaaccgggcagaauacaaaguucaccccagugggagucgugcaggacggcaacggugcucaccaaaaugagccccagcaguggguuuugccgucauacagcgggagaacuggccauaacgcccaccucgcacccgccguggcuccaacguuucccggagaacagcuguuauucuuuaggaguacaaugccuggcuguucuggguaccccaauaugaaccuggauugccuccuuccacaagaguggguacagcauuucuaucaggaggcggccccugcacaguccgacgucgcucuguugcgguuugugaaucccgauaccggacguguucuauucgaauguaaacugcacaagagcgguuacgugacugucgcccacaccggccaacaugaccucgugaucccaccgaacggguauuuucgcuucgauucguggguaaaccaguucuacacacuggcaccuaugggaaauggcaccgguagaaggcgggcccuuuga

SEQ ID NO: 19482 - RNA, 1623 nt, Artificial Sequence; identical to SEQ ID NO: 18127
  derived and/or modified sequence opt3 from capsid_protein__Norovirus__BAF74523

SEQ ID NO: 19483 - RNA, 1623 nt, Artificial Sequence; identical to SEQ ID NO: 18127
  derived and/or modified sequence opt3 from capsid_protein__Norovirus__BAF74524

SEQ ID NO: 19484 - RNA, 1623 nt, Artificial Sequence; identical to SEQ ID NO: 18127
  derived and/or modified sequence opt3 from capsid_protein__Norovirus__BAF74525

SEQ ID NO: 19485 - RNA, 1623 nt, Artificial Sequence
  derived and/or modified sequence opt3 from capsid_protein__Norovirus__BAF74526
augaagauggccagcaacgacgcuacccccuccgauggcucuacagcaaaucuggugccugaggucaacacugaaguuauggcccucgagccagugguaggggcggcuaucgccgcaccgguggccggacagcaaaaugucauugaccccuggauaagaaacaauuucgugcaggcuccugguggcgaauuuacgguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuaccgccggcaaaaucauuuucgcugccgugccuccaaacuuuccgacagagggccucucccccucucagguaacuauguucccucauaucauaguugacgugcgccaacuggagccaguccuuaucccccugccugaugugcgaaauaacuuuuaucacuacaaucagucgaacgacccaaccauuaaguugaucgcaaugcucuauacaccccugcguaccaauaacgcuggggaugacguguucacugucucaugcagaguucugacaaggccgagcccugauuuugacuucauuuuucucgugcccccaaccguagaaagucggacgaaaccuuucuccgugcccaucuuaacugucgaggaaaugaccaacucucgcuuuccaauaccccuggagaaacuuuucacaggaccuagcuccgccuucgugguucagccacagaaugguagauguacuaccgauggcguguugcuggggacaacccaacuaucaccggucaacauuugcacguuuaggggagacgugacucauaucgcgggcacacagaauuacaccaugaaccucgccagucagaauuggaacaauuaugaucccacugaggaaauuccugcaccacuggguacacccgacuucguagggaagauccagggaguucuuacccaaacgacccggcgcgacggcagcacacgaggccacaaggcuacugugucuaccggguccauccauuuuacaccuaagcugggaucaguccaguucagcacugauaccaguaacgacuuugagacaggucagaauaccagauucacuccagugggcgucgugcaagaugggucuacgacacaccagaacgaaccccagcaguggguuuugccggacuacuccggaagggauagccacaaugugcaucucgccccugcuguagccccaaccuuucccggcgagcaacuguuauucuuucggucgacuaugccugguuguucuggguaccccaacaugaaucuggacugccuccuuccacaggaauggguccagcacuucuaucaggaguccgccccugcacaaucagauguggcucuguugcguuuuguuaaccccgacaccggccgcgugcuauucgaguguaaacugcauaagaguggauacgucacaguggcgcacaccggccagcacgaucucguaauuccaccgaauggguauuuuagauucgacagcugggugaaccaguucuacacucuggcaccuaugggaaacggugccggcaggcggcgagcucuuuga

SEQ ID NO: 19486 - RNA, 1623 nt, Artificial Sequence
  derived and/or modified sequence opt3 from capsid_protein__Norovirus__BAF74527
augaagauggccagcaacgacgcuacccccuccgauggcucuacagcaaaucuggugccugaggucaacaaugaaguuauggcccucgagccagugguaggggcggcuaucgccgcaccgguggccggacagcaaaacgucauugaccccuggauaagaaauaacuucgugcaggcuccugguggcgaauuuacuguuucaccaaggaaugcacccggggagauccuuuggagugccccucugggaccagauuugaaccccuacuuaagccaccuggcucggauguauaauggcuacgccgguggguucgaagugcaggucauucuagcgggaaacgcauuuacggccggcaaaaucauuuucgcugccgugccuccaaauuuuccgaccgagggccucucccccucucagguaacaauguucccucauaucauaguugacgugcgccaacuggagccaguccuuaucccccugccugaugugcgaaacaauuuuuaucacuacaaccagucgaaugacccaacuauuaaguugaucgcaaugcucuauacgccccugcgugcuaacaacgccggggaugacguguucacagucucaugcagaguucugaccaggccgagcccugauuuugacuucauuuuucucgugcccccaacuguagaaagucggacaaaaccuuucuccgugcccaucuuaaccgucgaggaaaugaccaauucucgcuuuccaauaccccuggagaaacuuuucacuggaccuagcuccgcguucgugguucagccacagaacgguagauguaccacagauggcguguugcuggggacuacccaacuaucaccggucaauauuugcacauuuaggggagacgugacccauaucgccggcacgcagaacuacacuaugaaucucgcaagucagaacuggaauaacuaugaucccacagaggaaauuccugcuccacuggguacccccgacuucguagggaagauccagggaguucuuacucaaacaacccggcgcgacggcagcacgcgaggccacaaggccaccgugucuacaggguccauccauuuuacuccuaagcugggaucaguccaguucagcaccgauacaaguaaugacuuugagacuggucagaacaccagauucacaccagugggcgucgugcaagaugggucuaccacucaccagaaugaaccccagcaguggguuuugccggacuacuccggaagggauagccacaacgugcaucucgcuccugccguagcaccaacguuucccggcgagcaacuguuauucuuucggucgacaaugccugguuguucuggguaccccaauaugaaccuggacugccuccuuccacaggaauggguccagcacuucuaucaggaguccgccccugcucaaucagauguggcgcuguugcguuuuguuaaucccgacaccggccgcgugcuauucgaguguaaacugcauaagaguggauacgucacuguggcacacaccggccagcacgaucucguaauuccaccgaacggguauuuuagauucgacagcugggugaaccaguucuacacacuggccccuaugggaaauggugcuggcaggcggcgagcccuuuga

SEQ ID NO: 19487 - RNA, 1620 nt, Artificial Sequence
  derived and/or modified sequence opt3 from capsid_protein__Norovirus__BAF95499
augaagauggccagcaacgacgcuaaucccuccgauggcucuaccgcaaaccuggugccugaggucaauaacgaaguuauggcccucgagccagugguaggggcggcuaucgccgcaccgguggccggacagcaaaaugucaucgaccccuggauaagaaacaauuucgugcaggcuccugguggcgaauuuacaguuucaccaaggaacgcacccggggagauccuuuggagugccccucugggaccagauuugaaucccuacuuaagccaccuggcucggauguauaacggcuacgccgguggguucgaagugcaggucauucuagcgggaaaugcauuuacugccggcaaaaucauuuucgcugccgugccuccaaacuuuccgacggagggccucucccccucucagguaaccauguucccucauaucauaguugacgugcgccaacuggagccaguccuuaucccccugccugaugugcgaaauaacuuuuaucacuacaaucagucgaacgacucaacaauuaaguugaucgcaaugcucuauacuccacugcgugcuaacaaugccggggaugacguguucaccgucagcugcagaguucugacaaggcccaguccggauuuugacuucauuuuucucgugccucccaccguagaaucccggacuaaaccauucacagugccuaucuuaaccgucgaggaaaugucuaacagccgcuuucccgugccacuggagaaacuuuacacgggacccuccucagcguucguugugcagccucagaaugguagauguacuaccgauggcgucuugcuggggacaacucaacuaagugccgugaacauaugcaccuucaggggagacguaacacauauugcaggcagccacgauuauaccaugaaucucgcuucucagaacuggaauaacuacgacccaacggaggaaaucccggcuccccuggguacuccugacuuuguugggaagauucagggagugcuuacacagaccacucgggaggauggcuccacacgcgcccauaaggccaccgucucaacgggcagcgugcacuucaccccaaagcuggggaguguccaauacacaacugacaccaauaacgauuuucagacaggacagaauacuaaauucacccccguggguguuauccaagacggcucuaaccaccagaaugaaccucagcaguggguguugccaaacuauuccgggcgaacaggacauaauguacaccucgcacccgccgucgcuccgaccuuuccuggcgagcaacuguuauucuuuagaagcacuaugccagguuguucgggguaccccaacaugaaccuggauugccuccuuccucaggaaugggugcagcauuucuaucaggaggcggcacccgcccaaucugacguugcucuguugagguuugugaauccagauacgggccggguccuauucgaguguaagcugcacaaauccggauacgugacaguagcccacaccggcccucaugaccucgugauucccccaaacggguauuuucguuucgauucauggguuaaucaguuuuacacucuggcaccgaugggaaacggugccggccgcagaagggcucuuuga
